United States Patent
Bobzin et al.

(10) Patent No.: US 8,222,482 B2
(45) Date of Patent: Jul. 17, 2012

(54) MODULATING PLANT OIL LEVELS

(75) Inventors: Steven Craig Bobzin, Malibu, CA (US); Daniel Mumenthaler, Bonita, CA (US); Boris Jankowski, Newbury Park, CA (US); Joel Cruz Rarang, Granada Hills, CA (US)

(73) Assignee: Ceres, Inc., Thousand Oaks, CA (US)

( * ) Notice: Subject to any disclaimer, the term of this patent is extended or adjusted under 35 U.S.C. 154(b) by 656 days.

(21) Appl. No.: 12/161,935

(22) PCT Filed: Jan. 26, 2007

(86) PCT No.: PCT/US2007/002214
§ 371 (c)(1), (2), (4) Date: Apr. 15, 2009

(87) PCT Pub. No.: WO2007/089610
PCT Pub. Date: Aug. 9, 2007

(65) Prior Publication Data
US 2009/0324797 A1     Dec. 31, 2009

Related U.S. Application Data

(60) Provisional application No. 60/762,422, filed on Jan. 26, 2006, provisional application No. 60/797,077, filed on May 1, 2006.

(51) Int. Cl.
*A01H 1/00*     (2006.01)
*A01H 5/00*     (2006.01)
*A01H 5/10*     (2006.01)
*C12N 5/14*     (2006.01)

(52) U.S. Cl. ........ 800/278; 800/281; 800/295; 800/298; 800/306; 800/310; 800/312; 800/314; 800/322; 800/320.1; 800/320.2; 435/410; 435/419

(58) Field of Classification Search .................. None
See application file for complete search history.

(56) References Cited

U.S. PATENT DOCUMENTS

| | | |
|---|---|---|
| 4,987,071 A | 1/1991 | Cech et al. |
| 5,034,323 A | 7/1991 | Jorgensen et al. |
| 5,204,253 A | 4/1993 | Sanford et al. |
| 5,231,020 A | 7/1993 | Jorgensen et al. |
| 5,254,678 A | 10/1993 | Haseloff et al. |
| 5,538,880 A | 7/1996 | Lundquist et al. |
| 5,766,847 A | 6/1998 | Jackle et al. |
| 5,878,215 A | 3/1999 | Kling et al. |
| 5,945,306 A | 8/1999 | Bandman et al. |
| 5,998,700 A | 12/1999 | Lightfoot et al. |
| 6,004,753 A | 12/1999 | Yue et al. |
| 6,013,863 A | 1/2000 | Lundquist et al. |
| 6,287,778 B1 | 9/2001 | Huang et al. |
| 6,319,713 B1 | 11/2001 | Patten et al. |
| 6,326,527 B1 | 12/2001 | Kirihara et al. |
| 6,329,571 B1 | 12/2001 | Hiei |
| 6,417,429 B1 | 7/2002 | Hein et al. |
| 6,423,885 B1 | 7/2002 | Waterhouse et al. |
| 6,452,067 B1 | 9/2002 | Bedbrook et al. |
| 6,455,253 B1 | 9/2002 | Patten et al. |
| 6,500,614 B1 | 12/2002 | Arguello et al. |
| 6,521,453 B1 | 2/2003 | Crameri et al. |
| 6,573,099 B2 | 6/2003 | Graham |
| 6,648,930 B2 * | 11/2003 | Ulrich et al. ............... 44/308 |
| 6,753,139 B1 | 6/2004 | Baulcombe et al. |
| 6,777,588 B2 | 8/2004 | Waterhouse et al. |
| 6,906,244 B2 | 6/2005 | Fischer et al. |
| 7,173,121 B2 | 2/2007 | Fang |
| 7,214,789 B2 | 5/2007 | Pennell |
| 7,312,376 B2 | 12/2007 | Apuya et al. |
| 7,378,571 B2 | 5/2008 | Apuya |
| 7,402,667 B2 | 7/2008 | Cook et al. |
| 7,429,692 B2 | 9/2008 | Dang |
| 7,598,367 B2 | 10/2009 | Cook et al. |
| 2003/0175783 A1 | 9/2003 | Waterhouse et al. |
| 2003/0175965 A1 | 9/2003 | Lowe et al. |
| 2003/0180945 A1 | 9/2003 | Wang et al. |
| 2003/0233670 A1 | 12/2003 | Edgerton et al. |
| 2004/0137466 A1 | 7/2004 | Jofuku et al. |
| 2004/0214330 A1 | 10/2004 | Waterhouse et al. |
| 2005/0108791 A1 * | 5/2005 | Edgerton ................ 800/284 |
| 2006/0021083 A1 | 1/2006 | Cook |
| 2006/0041952 A1 | 2/2006 | Cook |
| 2006/0260004 A1 | 11/2006 | Fang et al. |
| 2007/0006335 A1 | 1/2007 | Cook |

FOREIGN PATENT DOCUMENTS

| | | |
|---|---|---|
| EP | 0 511 979 | 8/1994 |
| EP | 292 435 | 7/1995 |
| EP | 0 513 849 | 8/1998 |
| EP | 0 465 875 | 11/1998 |
| EP | 0 534 858 | 4/2000 |
| JP | 2004 121047 | 4/2004 |
| WO | 95/06128 | 3/1995 |
| WO | 97/01952 | 1/1997 |

(Continued)

OTHER PUBLICATIONS

U.S. Appl. No. 60/505,689, filed Sep. 23, 2003, Cook.
U.S. Appl. No. 60/518,075, filed Nov. 6, 2003, Pennell.
U.S. Appl. No. 60/544,771, filed Feb. 13, 2004, Cook.
U.S. Appl. No. 60/558,869, filed Apr. 1, 2004, Cook.
U.S. Appl. No. 60/583,609, filed Jun. 30, 2004, Alexandrov.
U.S. Appl. No. 60/583,691, filed Jun. 30, 2004, Alexandrov.
U.S. Appl. No. 60/612,891, filed Sep. 23, 2004, Kwok.
U.S. Appl. No. 60/637,140, filed Dec. 16, 2004, Feldman.
U.S. Appl. No. 60/757,544, filed Jan. 9, 2006, Dang.
U.S. Appl. No. 60/776,307, filed Feb. 24, 2006, Kwok.
Abler et al. "Isolation and characterization of a genomic sequence encoding the maize Cat3 catalase gene" *Plant Mol. Biol.*, 22:1031-1038 (1993).

(Continued)

*Primary Examiner* — Eileen B O Hara
(74) *Attorney, Agent, or Firm* — Fish & Richardson P.C.

(57) ABSTRACT

Methods and materials for modulating (e.g., increasing or decreasing) oil levels in plants are disclosed. For example, nucleic acids encoding oil-modulating polypeptides are disclosed as well as methods for using such nucleic acids to transform plant cells. Also disclosed are plants having increased oil levels and plant products produced from plants having increased oil levels.

55 Claims, 25 Drawing Sheets

FOREIGN PATENT DOCUMENTS

| | | |
|---|---|---|
| WO | 98/36083 | 8/1998 |
| WO | 98/53083 | 11/1998 |
| WO | 99/32619 | 7/1999 |
| WO | 99/53030 | 10/1999 |
| WO | 00/31281 | 6/2000 |
| WO | 01/18191 | 3/2001 |
| WO | 01/35725 | 5/2001 |
| WO | 01/75164 | 11/2001 |
| WO | 02/10210 | 2/2002 |
| WO | 02/15675 | 2/2002 |
| WO | 02/16655 | 2/2002 |
| WO | 02/46449 | 6/2002 |
| WO | 02/081714 | 10/2002 |
| WO | 03/013227 | 2/2003 |
| WO | 03/095654 | 11/2003 |
| WO | 2005/011105 | 2/2005 |
| WO | 2005/023639 | 3/2005 |
| WO | 2005/034308 | 4/2005 |
| WO | 2005/098007 | 10/2005 |
| WO | 2006/005023 | 1/2006 |
| WO | 2006/034479 | 3/2006 |

OTHER PUBLICATIONS

Ahn et al., "Homoeologous relationships of rice, wheat and maize chromosomes" *Molecular and General Genetics*, 241:483-490 (1993).

Alonso-Blanco et al., "The use of recombinant inbred lines (RILs) for genetic mapping," In Methods in Molecular Biology (J.M. Martinez-Zapater and J. Salinas, Humana Press, Totowa, NJ., 1998), 82: 137-146.

An et al., "New cloning vehicles for transformation of higher plants," *The EMBO Journal*, 1985, 4(2): 277-284.

Apuya et al., "RASPBERRY3 Gene encodes a Novel Protein Important for Embryo Development," *Plant Physiology*, 2002, 129(2):691-705.

Armaleo et al., "Biolistic nuclear transformation of *Saccharomyces cerevisiae* and other fungi," *Current Genetics*, 1990, 17: 97-103.

Baerson et al., "Developmental regulation of an acyl carrier protein gene promoter in vegetative and reproductive tissues" *Plant Mol. Biol.*, 22(2):255-267 (1993).

Bateman et al., "Pfam 3.1: 1313 multiple alignments and profile HMMs match the majority of proteins" *Nucl. Acids Res.*, 27(1):260-262 (1999).

Baud et al., An integrated overview of seed development in *Arabidopsis thaliana* ecotype WS, *Plant Physiol. Biochem.*, 2002, 40:151-160.

Bechtold et al., "*In planta Agrobacterium* mediated gene transfer by infiltration of adult *Arabidopsis thaliana* plants" *C.R. Acad. Sci. Paris*, 316:1194-1199 (1993).

Bonner et al., "Reduction in the rate of DNA reassociation by sequence divergence" *J. Mol. Biol.*, 81:123-135 (1973).

Bradshaw et al., "A new vector for recombination-based cloning of large DNA fragments from yeast artificial chromosomes," *Nucl. Acids. Rec.*, 1995, 23(23): 4850-4856.

Broothaerts et al., "Gene transfer to plants by diverse species of bacteria," *Nature*, 2005, 433: 629-633.

Brummell, et al., "Inverted repeat of a heterologous 3'-untranslated region for high-efficiency, high-throughput gene silencing" *Plant J.* 33:793-800 (2003).

Burke et al., "Cloning of large segments of exogenous DNA into yeast by means of artificial chromosome vectors," *Science*, 1987, 236: 806-812.

Burr et al., "Gene mapping with recombinant inbreds in maize," *Genetics*, 1988, 118: 519-526.

Burr et al., "Mapping Genes with Recombinant Inbreds," In Freeling and Walbot (Ed.), *The Maize Handbook*, (New York, Springer-Verlag, 1994), pp. 249-254.

Bustos et al., "Regulation of b-glucuronidase expression in transgenic tobacco plants by an A/T-rich, *cis*-acting sequence found upstream of a French bean b-phaseolin gene" *Plant Cell*, 1(9):839-854 (1989).

Carels et al., "Compositional properties of homologous coding sequences from plants" *J. Mol. Evol.*, 46:45-53 (1998).

Cerdan et al., "A 146 by fragment of the tobacco *Lhcb1\*2* promoter confers very-low-fluence, low-fluence and high-irradiance responses of phytochrom to a minimal CaMV 35S promoter" *Plant Mol. Biol.*, 33:245-255 (1997).

Chan et al., "*Agrobacterium*-mediated production of transgenic rice plants expressing a chimeric a-amylase promoter/Θglucuronidase gene," *Plant Mol. Biol.*, 1993, 22: 491-506.

Chen et al., "Functional analysis of regulatory elements in a plant embryo-specific gene" *Proc. Natl. Acad. Sci. USA*, 83:8560-8564 (1986).

Cheng et al., "Highly divergent methyltransferases catalyze a conserved reaction in tocopherol and plastoquinone synthesis in cyanobacteria and photosynthetic eukaryotes," *Plant Cell*, 2003, 15: 2343-2356.

Chenna et al., "Multiple sequence alignment with the Clustal series of programs" *Nucleic Acids Res.*, 31(13):3497-3500 (2003).

Chickova et al., "Transgenic tobacco plants that overexpress alfalfa NADH-glutamate synthase have higher carbon and nitrogen content," *Journal of Experimental Botany*, 2001, 52(364): 2079-2087.

Christou, "Strategies for variety-independent genetic transformation of important cereals, legumes and woody species utilizing particle bombardment" *Euphytica*, 85(1-3):13-27, (1995).

Conceicao, "A cotyledon regulatory region is responsible for the different spatial expression patterns of *Arabidopsis* 2S albumin genes" *The Plant Journal*, 1994, 5(4):493-505.

Conkling et al. "Isolation of transcriptionally regulated root-specific genes from tobacco" *Plant Physiol.*, 93:1203-1211, (1990).

Conner and Domisse, Monocotyledonous plants as hosts for *Agrobacterium*, *Int. J. Plant Sci.*, 1992, 153(4): 550-555.

Dai et al., "RF2b, a rice bZIP transcription activator, interacts with RF2a and is involved in symptom development of rice tungro disease" *Proc. Natl. Acad. Sci. USA*, 101(2):687-692 (2004).

de Feyter and Gaudron, Methods in Molecular Biology, vol. 74, Chapter 43, "Expressing Ribozymes in Plants", Edited by Turner, P.C., *Humana Press Inc.*, Totowa, NJ, 1997, pp. 403-415.

deVicente and Tanksley,"QTL analysis of transgressive segregation in an interspecific tomato cross," *Genetics*, 1993, 134: 585-596.

Dietrich et al., "AtPTR1, a plasma membrane peptide transporter expressed during seed germination and in vascular tissue of *Arabidopsis*," *Plant Journal*, 2004, 40(4): 488-499.

Do et al., "ProbCons: Probabilistic consistency-based multiple sequence alignment," *Genome Res.*, 2005, 15(2): 330-340.

Durbin et al., "3-Markov chains and hidden Markov models; 4-Pairwise alignment using HMMS; 5-Profile HMMs for sequence families" In Biological Sequence Analysis: Probabilistic Models of Proteins and Nucleic Acids, (Cambridge University Press, Cambridge, 45 pages.

Escudero et al., "T-DNA transfer in meristematic cells of maize provided with intracellular *Agrobacterium*" *Plant J.*, 10(2): 355-360 (1996).

Evans et al., Protoplasts Isolation and Culture in "Handbook of Plant Cell Culture," pp. 124-176, *MacMillilan Publishing Company*, New York, 1983.

Ezeagu et al., "Seed protein contents and nitrogen-to-protein conversion factors for some uncultivated tropical plant seeds," *Food Chemistry*, 2002, 78: 105-109.

Fejes et al., "A 268 bp upstream sequence mediates the circadian clock-regulated transcription of the wheat Cab-1 gene in transgenic plants" *Plant Mol. Biol.*, 15:921-932 (1990).

Fennoy et al. "Synonymous codon usage in *Zea mays* L. nuclear genes is varied by levels of C and G-ending codons" *Nucleic Acids Research*, 21(23):5294-5300 (1993).

Foyer et al., "Adaptations of photosynthetic electron transport, carbon assimilation, and carbon partitioning in transgenic *Nicotiana plumbaginifolia* plants to changes in nitrate reductase activity," *Plant Physiology*, 1994, 104(1): 171-178.

Fraisier et al., "Constitutive expression of a putative high-affinity nitrate transporter in *Nicotiana plumbaginifolia*: Evidence for post-transcriptional regulation by a reduced nitrogen source," *Plant Journal*, 2000, 23(4): 489-496.

Fraley et al., "Genetic transformation in higher plants," *Crit. Rev. Plant. Sci.*, 1986, 4(1): 1-46.

Frischauf et al., "Lambda replacement vectors carrying polylinker sequences," *J. Mol. Biol.*, 1983, 170: 827-842.
Fromm et al., "An octopine synthase enhancer element directs tissue-specific expression and binds ASF-1, a factor from tobacco nuclear extracts" *The Plant Cell*, 1:977-984 (1989).
Fromm et al., "Inheritance and expression of chimeric genes in the progeny of transgenic maize plants," *Biotechnology*, 1990, 8: 833-844.
Gardiner et al., "Development of a core RFLP map in maize using an immortalized F2 population," *Genetics*, 1993, 134: 917-930.
GenBank Accession No. AAC28509, dated Aug. 4, 1998, 2 pages.
GenBank Accession No. AAO24547, dated Jan. 21, 2003, 3 pages.
GenBank Accession No. AF096096, dated Jan. 25, 1999, 2 pages.
GenBank Accession No. AF129516, dated Apr. 6, 1999, 2 pages.
GenBank Accession No. AL163815.1, dated Nov. 14, 2006, 49 pages.
GenBank Accession No. BAC43284, dated Feb. 14, 2004, 2 pages.
GenBank Accession No. CAB87794, dated Nov. 15, 2006, 2 pages.
GenBank Accession No. CAB87717, dated Nov. 14, 2006, 3 pages.
GenBank Accession No. L05934, dated Oct. 22, 1993, 3 pages.
GenBank Accession No. NM_112313, dated Jun. 9, 2006, 3 pages.
GenBank Accession No. NM_121195, dated Jan. 10, 2002, 3 pages.
GenBank Accession No. NM_101234, dated Jun. 9, 2006, 3 pages.
GenBank Accession No. NM_103793, dated Jun. 9, 2006, 2 pages.
GenBank Accession No. NM_122025, dated Jun. 9, 2006, 2 pages.
GenBank Accession No. NM_130084, dated Jun. 9, 2006, 3 pages.
GenBank Accession No. NM_180224, dated Jun. 9, 2006, 3 pages.
GenBank Accession No. NP_175330, dated Jun. 9, 2006, 2 pages.
GenBank Accession No. NP 182046, dated Jun. 9, 2006, 2 pages.
GenBank Accession No. NP_188071, dated Jun. 9, 2006, 3 pages.
GenBank Accession No. NP 196718, dated Jun. 9, 2006, 2 pages.
GenBank Accession No. NP 197518, dated Jun. 9, 2006, 2 pages.
GenBank Accession No. NP 563930, dated Jun. 9, 2006, 3 pages.
GenBank Accession No. NP 850555, dated Jun. 9, 2006, 2 pages.
GenBank Accession No. U93215, dated Feb. 27, 2002, 42 pages.
GenBank Accession No. Q9LPV5, dated Mar. 1, 2004, 3 pages.
Ghosh et al. "Trangenic Indica rice (*Oryza sativa* L.) plants obtained by direct gene transfer to protoplasts" *J. Biotechnol.*, 32:1-10 (1994).
Gleave, AP., "A versatile binary vector system with a T-DNA organizational structure conducive to efficient integration of cloned DnA into the plant genome" Plant Mol. Biol. 20:1203-1207 (1992).
Gordon-Kamm et al., "Transformation of maize cells and regeneration of fertile transgenic plants," *Plant Cell*, 1990, 2: 603-618.
Guo et al., "Protein tolerance to random amino acid change," *PNAS*, 2004, 101(25): 9205-9210.
Gould et al., "Transformation of *Zea mays* L. Using *Agrobacterium tummefaciens* and the shoot apex" *Plant Physiology*, 95:426-434 (1991).
Graves and Goldman, "The transformation of *Zea mays* seedling with *Agrobacterium tumefaciens*" *Plant Mol. Biol.*, 7:43-50 (1986).
Green et al., "Binding site requirements for pea nuclear protein factor GT-1 correlate with sequences required for light-dependent transcriptional activation of the *rbcS-3A* gene" *EMBO J.*, 7:4035-4044 (1988).
Hamilton et al., "Stable transfer of intact high molecular weight DNA into plant chromosomes," *Proc. Natl. Acad. Sci.*, USA, 1996, 93: 9975-9979.
Hamilton, "A binary-BAC system for plant transformation with high-molecular-weight DNA" *Gene*, 200:107-116 (1997).
Heath et al., Analysis of storage proteins in normal and aborted seeds from embryo-lethal mutants of *Arabidopsis thaliana, Planta*, 1986, 169: 304-312.
Henkel, "Soy: Health claims for soy protein, questions about other components," *FDA Consumer*, 2000, 3 pages.
Herrera-Estrella et al., "Chimeric genes as dominant selectable markers in plant cells" *EMBO J.*, 2(6):987-995 (1983).
Hiei et al., "Efficient transformation of rice (*Oryza sativa L*) mediated by *Agrobacterium*and sequence analysis of the boundaries of the T-DNA," *Plant Journa,*, 1994, 6(2): 271-282.
Hill et al., "Carbon supply for storage-product synthesis in developing seeds of oilseed rape," *Biochemical Society Transactions*, 2000, 28(6): 667-669.

Hong et al., "Promoter sequences from two different *Brassica napus* tapetal oleosin-like genes direct tapetal expression of β-glucuronidase in transgenic *Brassica* plants" *Plant Mol Biol.*, 1997 34(3):549-555.
Hosoyama et al. "Oryzacystatin exogenously introduced into protoplasts and regeneration of transgenic rice" *Biosci. Biotechnol. Biochem.* 58(8): 1500-1505 (1994).
Huang et al., "Cloning and functional characterization of an *Arabidopsis* nitrate transporter gene that encodes a constitutive component of low-affinity uptake," *Plant Cell*, 1999, 11: 1381-1392.
Huynh et al., In Glover NM (ed) DNA Cloning: A practical approach, vol. 1 (Oxford, IRL Press, 1985) , pp. 49-78.
Hwang et al, "Aleurone- and embryo-specific expression of the β-glucuronidase gene controlled by the barley *Chi26* and *Ltp1* promoters in transgenic rice" *Plant Cell Rep.* 20(7):647-654 (2001).
Hwang et al., "Cloning and functional characterization of an *Arabidopsis* nitrate transporter gene that encodes a constitutive component of low-affinity uptake," *Plant Cell*, 1999, 11(8): 1381-1392.
Hyrup et al., Peptide nucleic acids (PNA): synthesis, properties and potential applications *Bioorgan. Med. Chem.*, 4:5-23 (1996).
Ishida et al., "High efficiency transformation of maize (*Zea mays* L. mediated by *Agrobacterium tumefaciens*" *Nature Biotechnology*, 14:745-750 (1996).
Jako et al., "Seed-specific over-expression of an *Arabidopsis* cDNA encoding a diacylglyerol acyltransferase enhances seed oil content and seed weight," *Plant Physiology*, 2001, 126(2): 861-874.
Jordano et al., "A sunflower helianthinin gene upstream sequence ensemble contains an enhancer and sites of nuclear protein interaction" *Plant Cell*, 1:855-866 (1989).
Katavic et al., "Utility of the *Arabidopsis*FAE1 and yeast SLCI-1 genes for improvements in erucic acid and oil content in rapeseed," *Biochemical Society Transactions*, 2000, 28(6): 935-937.
Keller and Baumgartner, "Vascular-specific expression of the bean GRP 1.8 gene is negatively regulated" *Plant Cell*, 3(10):1051-1061 (1991).
Keller and Manak "DNA Probes Section One: Molecular Hybridization Technology", 2nd Ed. c. 1993 by Stockton Press, New York, NY, pp. 1-25.
Keskin et al., "A new, structurally nonredundant, diverse data set of protein-protein interfaces and its implications," *Protein Science*, 2004, 13: 1043-1055.
Klee et al. "Agrobacterium-mediated plant transformation and its further applications to plant biology" *Ann. Rev. of Plant Phys.*, 38:467-486 (1987).
Klein et al., "High-velocity microprojectiles for delivering nucleic acids into living cells," *Nature*, 1987, 327: 70-73.
Koch et al., "Reduced amino acid content in transgenic potato tubers due to antisense inhibition of the leaf H+/amino acid symporter StAAP1," *Plant Journal*, 2003, 33(2): 211-220.
Komari et al., "Vectors carrying two separate T-DNAs for co-transformation of higher plants mediated by *Agrobacterium tumefaciens* and segregation of transformants free from selection markers" *Plant J.*, 10(1): 165-174 (1996).
Koziel et al., "Field performance of elite transgenic maize plants expressing an insecticidal protein derived from *Bacillus thuringiensis*," Biotechnology, 1993, 11: 194-200.
Lam et al., "Site-specific mutations in alter in vitro factor binding and change promoter expression pattern in transgenic plants" *Proc. Natl. Acad. Sci. USA*, 86:7890-7894 (1989).
Lassner et al., "A jojoba beta-Ketoacyl-CoA synthase cDNA complements the canola fatty acid elongation mutation in transgenic plants," *Plant Cell*, 1996, 8(2): 281-292.
Li et al., "Oil content of arabidopsis seeds: The influence of seed anatomy, light and plant-to-plant variation," *Phytochemistry*, 2006, 67: 904-915.
Liljegren, "Interactions among *APETALA1, LEAFY*, and *Terminal FLOWER1* specify meristem fate" *Plant Cell*, 11:1007-1018 (1999).
Luan et al., "A rice *cab* gene promoter contains separate cis-acting elements that regulate expression in dicot and monocot plants" *The Plant Cell*, 4:971-981 (1992).
Lubberstedt et al., "Promoters from genes for plastid proteins possess regions with different sensitivities toward red and blue light" *Plant Physiol.*, 104:997-1006 (1994).

Marra et al., "High throughput fingerprint analysis of large-insert clones," *Genomic Research*, 1997, 7: 1072-1084.

Matsuoka et al., "Tissue-specific light-regulated expression directed by the promoter of a C4 gene, maize pyruvate, orthophosphate dikinase, in a C3 plant, rice" *Proc. Natl. Acad. Sci. USA*, 90:9586-9590 (1993).

Matteucci et al. "Synthesis of Deoxyoligonucleotides on a polymer support" *J. Am. Chem. Soc.*, 103:3185-3191 (1981).

May et al., "Generation of transgenic banana (*Musa acuminate*) plants via *Agrobacterium*-mediated transformation" *Bio/Technology*, 13:486-492 (1995).

McAlister-Henn et al., "Application of the yeast two-hybrid system," *Methods*, 1999, 19: 330-337.

McClure et al., "Transcription, Organization, and Sequence of an Auxin-Regulated Gene Cluster in Soybean," *Plant Cell*, 1989, 1:229-239.

McCormac et al., "A flexible series of binary vectors for agrobacterium-mediated plant transformation" *Mol. Biotechnol.*, 8:199-213 (1997).

McCormick et al., "Leaf disc transformation of cultivated tomato (*L. esculentum*) using *Agrobacterium tumefaciens*,"*Plant Cell Reports*, 1986, 5: 81-84.

Medberry et al., "The Commelina yellow mottle virus promoter is a strong promoter in vascular and reproductive tissues" *Plant Cell*, 4(2):185-192 (1992).

Meier et al., "Elicitor-inducible and constitutive in vivo DNA footprints indicate novel *cis*-acting elements in the promoter of a parsley gene encoding pathogenesis-related protein 1" *Plant Cell*, 3:309-316 (1991).

Müller et al., "High meiotic stability of a foreign gene introduced into tobacco by *Agrobacterium*-mediated transformation" *Mol. Gen. Genet.*, 207:171-175 (1987).

Needleman and Wunsch "A general method applicable to the search for similarities in the amino acid sequence of two proteins" *J. Mol. Biol.*, 48:443-453 (1970).

Nehra et al., "Self-fertile transgenic wheat plants regenerated from isolated scutellar tissues following microprojectile bombardment with two distinct gene constructs," *Plant Journal*,1994, 5(2): 285-297.

Panaud et al., "Frequency of microsatellite sequences in rice (*Oryza sative L.*)," *Genome*, 1995, 38:1170-1176.

Paszkowski et al. "Direct gene transfer to plants" *EMBO J.*, 3:2717-2722 (1984).

Pearson and Lipman "Improved tools for biological sequence comparison" *Proc. Natl. Acad. Sci. USA*, 85: 2444-2448 (1988).

Perriman et al., "Effective ribozyme delivery in plant cells" Proc. Natl. Acad. Sci. USA, 92(13):6175-6179 (1995).

Pfam web cite (describing concensus sequences for a variety of protein motifs and domains at sanger.ac.uk/Pham and genome.wustl.edu.Pfan, 2006, 2 pages.

Prioli and Soendahl, "Plant regeneration and revocery of fertile plants from protoplasts of maize (*Zeo mays L.*)," *Bio/Technology*, 1989, 7: 589-594.

Refseth et al., "Hybridization capture of microsatellites directly from genomic DNA" *Electrophoresis*, 18:1519-1523 (1997).

Rhee, "Determination of total nitrogen" in Handbook of Food Analytical Chemistry—Water, Proteins, Enzymes, Lipids, and Carbohydrates. (R. Wrolstad et al, ed.) *John Wiley and Sond, Inc.*, 2005, p. 105-113.

Ritala et al., "Fertile transgenic barley by particle bombardment of immature embryos," *Plant Mol. Biol.*, 1994, 24: 317-325.

Riggs et al., "Cotyledon nuclear proteins bind to DNA fragments harboring regulatory elements of phytohemagglutinin genes" *Plant Cell*, 1(6):609-621 (1989).

Ritchie et al., "*Agrobacterium tumefaciens*-mediated expression of gusA in maize tissues," *Transgenic Res.*, 1993, 2: 252-265.

Rivera et al, "Genomic evidence for two functionally distinct gene classes" *Proc. Natl. Acad. Sci. USA* , 95:6239-6244 (1998).

Salomon et al., "Genetic identification of functions of TR-DNA transcripts in octopine crown galls" *EMBO J.*, 3:141-146 (1984).

Sambrook et al., 1989, "Molecular Cloning, A Laboratory Manual", second edition, *Cold Spring Harbor Press*, Plainview; NY, 21 pages.

Senior et al., "Simple sequence repeat markers developed from Maize sequences found in the Genbank database: Map construction," *Crop Science*, 1996, 36:1676-1683.

Shen et al., "The homeobox gene *GLABRA2*affects seed oil content in *Arabidopsis*," *Plant Molecular Biology*, 2006, 60 (3): 377-387.

Smith and Waterman, "Comparison of Biosequences" Advances in Applied Mathematics., 2:482-489 (1981).

Sheridan, "The *mac1* Gene: Controlling the commitment to the meiotic pathway in Maize" *Genetics*, 142:1009-1020 (1996).

Shillito et al., "Regeneration of fertile plants form protoplasts of elite inbred maize," *Bio/Technology*, 1989, 7: 581-587.

Shizuya et al., "Cloning and stable maintenance of 300-kilobase-pair fragments of human DNA in *Escherichia coli* using an F-factor-based vector," *Proc. Natl. Acad. Sci*, USA, 1992, 89: 8794-8797.

Singh et al., "Transgenic expression of a delta 12-epoxygenase gene in *Arabidopsis* seeds inhibits accumulation of linoleic acid," *Planta*, 2001, 212: 872-879.

Slocombe et al., "Temporal and tissue-specific regulation of a *Brassica napus* stearoyl-acyl carrier protein desaturase gene" *Plant Physiol.*, 104(4):1167-1176 (1994).

Sonnhammer et al., "Pfam: A comprehensive database of protein domain families based on seed alignments" *Proteins*, 28:405-420 (1997).

Sonnhammer et al., "Pfam: multiple sequence alignments and HMM-profiles of protein domains" *Nucl. Acids Res.*, 26:320-322 (1998).

Spencer et al., "Bialaphos selection of stable transformants from maize cell culture," *Theor. Appl. Genet.*, 1990, 79: 625-631.

Sternberg et al., "Bacteriophage P1 cloning system for the isolation, amplification, and recovery of DNA fragments as large as 100 kilobase pairs," *Proc. Natl. Acad. Sci. USA*, 1990, 87(1): 103-107.

Summerton and Weller, "Morpholino antisense oligomers: design, preparation, and properties" *Antisense Nucleic Acid Drug Dev.*, 7:187-195 (1997).

Tanksley and McCouch, "Seed banks and molecular maps: Unlocking genetic potential from the wild," *Science*, 1997, 277: 1063-1066.

Taramino et al., "Simple sequence repeats for germplasm analysis and mapping in maize," *Genome*, 1996, 39(2): 277-287.

Thornton et al., "From structure to function: approaches and limitations," *Nature Structural Biology*, 2000, pp. 991-994.

Tijessen, "Hybridization with Nucleic Acid Probes" in Laboratory Techniques in Biochemistry and Molecular Biology, P.C. vand der Vliet, ed., c. 1993 by *Elsevier*, Amsterdam, pp. 19-78.

Tomlinson et al., "Evidence that the hexose-to sucrose ration does not control the switch to storage product accumulation in oilseeds: analysis of tobacco seed development and effects of overexpressing apoplastic invertase," *Journal of Experimental Botany*, 2004, 55(406): 2291-2303.

Truernit et al., "The promoter of the *Arabidopsis thaliana* SUC2 sucrose-H$^+$ symporter gene directs expression of β-glucuronidase to the phloem: Evidence for phloem loading and unloading by SUC2" *Planta*. 196:564-570 (1995).

Tsay et al., "Nitrate transporters and peptide transporters," *FEBS Letters*, 2007, 581: 2290-2300.

Tuskan et al., "The genome of black cottonwood, Populus trichocarpa," *Science*, 2006, 313(5793): 1596-1604.

Urao et al. "Molecular cloning and characterization of a gene that encodes a MYC-related protein in *Arabidopsis*" *Plant Mol. Biol.*, 32:571-576 (1996).

Urdea et al. "Chemical synthesis of a gene for human epidermal growth factor urogastrone and its expression in yeast" *Proc. Natl. Acad. Sci. USA*, 80:7461-7465 (1983).

Vasil et al., "Rapid production of transgenic wheat plants by direct bombardment of cultured immature embryos," *Bio/Technology*, 1993, 11: 1553-1558.

Venkateswarlu et al., "Evidence for T-DNA mediated gene targeting to tobacco chloroplasts" *Biotechnology*, 9:1103-1105 (1991).

Walden and Cowan, "A novel 205-kilodalton testis-specific serine/threonine protein kinase associated with microtubules of the spermatid manchette," *Mol. Cell Biol.*, 1993, 13(12): 7625-7635.

Wan and Lemaux, "Generation of large number of independently transformed fertile barley plants," *Plant Physiol.*, 1994, 104: 37-48.

Weber et al., "Interaction of cytosolic and plastidic nitrogen metabolism in plants," *Journal of Experimental Botany*, 2002, 53(370): 865-874.

Weising et al., "Foreign genes in plants: transfer, structure, expression, and applications" *Ann. Rev. Genet.*, 22:421-477 (1988).

Willmitzer (Willmitzer, L. (1993) Transgenic plants. In : Biotechnology, A Multi-Volume Comprehensive Treatise (H.G. Rehm, G. Reed, A. Puehler, P. Stadler, eds.). vol. 2, 627-659, VCH Weinheim-New York-Basel-Cambridge).

Wilmink et al., "Expression of the GUS-gene in the monocot tulip after introduction by particle bombardment and *Agrobacterium*," *Plant Cell Reports*, 1992, 11: 76-80.

Yamamoto et al., "The promoter of a pine photosynthetic gene allows expression of a β-glucuronidase reporter gene in transgenic rice plants in a light-independent but tissue-specific manner" *Plant Cell Physiol.*, 1994, 35:773-778.

Yan et al., "New construct approaches for efficient gene silencing in plants," *Plant Physiology*, 2006, 141: 1508-1518.

Yanagisawa et al., "Metabolic engineering with Dof1 transcription factor in plants: Improved nitrogen assimilation and growth under low-nitrogen conditions" *Proc. Natl. Acad. Sci. USA*, 101(20):7833-7838 (2004).

Zhang et al., "DNA sequences that activate isocitrate lyase gene expression during late embryogenesis and during postgerminative growth," *Plant Physiology*, 110:1069-1079 (1996).

Zheng et al., "*SPK1* is an Essential S-Phase-Specific Gene of *Saccharomyces cerevisiae* that encodes a nuclear serine/threonine/tyrosine kinase" *Mol. Cell Biol.*, 1993, 13:5829-5842.

\* cited by examiner

Figure 1

| | | | | |
|---|---|---|---|---|
| gi\|2739168 | PI NLSHHPYW | NI GGHDSGDV | LSQVLQIFGS | HILTLVDKQL | PTGEIAPIKN | 234 |
| Lead-Lead117-CeresClone41573 | PVNLAHHSYW | NLGGHNSGDI | LSEELQILGS | GYTPVDGEL- | PTGKINPVKG | 175 |
| gi\|50920801 | PVNLAQHTYW | NLRGHGNGTL | LDHSVQIFAS | AVTPVQAGL- | PTGAVSPVSG | 249 |
| CeresClone:1371577 | PVNLAHHAYW | NLCGDGSSGNV | LGEEVRLFAS | RYTPVDASL- | PTGRMASVAG | 240 |
| CeresClone:1560908 | PVNLAQHTYW | NLCGGQSCDV | LRNTVQLFAS | RYTPVGGL- | PTGAVAPVAG | 237 |
| CeresClone:1314177 | PVNLAQHTYW | NLGGESGDV | LGNTVQLFAA | RYTPVDATL- | PTGQLAPVAG | 237 |
| Consensus | PVNLA-HTYW | NLGG-GSGDV | L---TVQ-FAS | RYTPVDA-LI | PTG---APVAG | 250 |
| | | | | | | |
| gi\|2739168 | TPYDFLKPRK | VGSRINKLKN | --------- | --------G | ---EKMKPVG | 272 |
| Lead-Lead117-CeresClone41573 | TAYDFLQLRP | KDNMKDLKT | --------- | --------G | A--RKKMRKIV | 214 |
| gi\|50920801 | TPFDFRAPAP | PGARIADVPG | G-------- | --------C | ADGQGVRKAA | 291 |
| CeresClone:1371577 | TPYDFRTPAA | VGSRICGLLS | RGVN----- | --------G | ---RGLRPVA | 281 |
| CeresClone:1560908 | TPYDFLAPAA | CKAG-ROVSG | CKAG---VYG | --------C | P--GALRKVA | 282 |
| CeresClone:1314177 | TPYDLCRAPTA | VREHLROVVG | CSSNGSTIYG | --------G | A--RALRKVA | 285 |
| Consensus | TPYDF-APAA | VGSRI RQ--- | G--------- | --------G | A-----MRKVA | 300 |
| | | | | | | |
| gi\|2739168 | VYDKKSGRV | MDVQASSPGV | QFYTANFVNN | TKGKGGFVYQ | PHSALSLETL | 322 |
| Lead-Lead117-CeresClone41573 | ELVDKKSGRK | MELSGNQACL | QFYTGCML-KD | VKGKNGAAYQ | AFGGLCLETQ | 264 |
| gi\|50920801 | VSEPTSGRV | LELWSDQPGL | QFYTGNFLKG | DEGKCGARY | KHCGLCLETQ | 341 |
| CeresClone:1371577 | VVRDGASGRA | MELWADQPGV | QFYTANGLSG | VRGKGGKKYG | HYGALCLETQ | 331 |
| CeresClone:1560908 | VVRDGASGRA | LELWANQPGV | QFYTGNFLOD | VKGKGGKVYQ | QYGALCLETQ | 332 |
| CeresClone:1314177 | AVRDGASGRA | LELWADQPGV | QFYTGNFLQD | VKGKGGSVYQ | QYGALCLETQ | 335 |
| Consensus | VVRDGASGRA | -ELWADQPGV | QFYTGNFL-D | VKGKGGAVYQ | QYGALCLETQ | 350 |
| | | | | | | |
| gi\|2739168 | VFPDAVNHPN | FPSTIVNPGE | -KYVHSVLYL | FSIKK- | | 356 |
| Lead-Lead117-CeresClone41573 | SYPDALNHPK | FPSQIVEPGK | -KYKHTMLFK | FSIVS- | | 298 |
| gi\|50920801 | DYPDAVHNAK | FPTEIYRKGQ | -EYKHYMLYK | FSLAKK | | 376 |
| CeresClone:1371577 | GFPDAVNRPS | FPSQIVRPGK | -VYKHDMVFK | FSF-- | | 363 |
| CeresClone:1560908 | GFPDAVNHPD | FPSQIVRPGQ | -VYKHDMVFK | FSF-- | | 364 |
| CeresClone:1314177 | GFPDAVNHPE | FPSQIVRPGQ | AAYKHDMVFK | FSF-- | | 368 |
| Consensus | GFPDAVNHP- | FPSQIVRPGQ | -KYKHDM-FK | FS---- | | 386 |

Figure 2

| | | | | | |
|---|---|---|---|---|---|
| CeresClone:953928 | MKVVAAFLLA | VLSGKACPTS | ADIKMLNSV | GCETEDSQIE | LLLKEVNGKD | 50 |
| CeresClone:426736 | MKVVAAYLLA | VLSGKASPTS | ADIKTILGSV | GAETEDSQIE | LLLKEVKGKD | 50 |
| Lead-Lead118-CeresClone25429 | MKVAAAFLLA | VLGGNANPSA | ENIKDIGAV | GADVDGESE | LLLKEVSGKD | 50 |
| CeresClone:524682 | MKVVAAYLLA | VLGGNNSPSA | DVIKEILGSV | GVEADEDRIE | SFLSEVKGKD | 50 |
| CeresGdna:1488311 | MKVVAAYLLA | LLGGNTCPTA | EDLKHILGSV | GADADDDRIE | LLLSSVKGKD | 50 |
| CeresClone:1609735 | MKVVAAYLLA | VLGGNTSPSA | EDLKNILGSV | GADCDDDKIE | LLLSEVKGKD | 50 |
| gi\|42565379 | MKVVAAYLLA | VLGGNTTPSA | EVIKDILGSV | GADAEDDRIE | LLLSEVKGKD | 50 |
| gi\|24473796 | MKVVAAYLLA | VLGGNTTPSA | EDLKDILGSV | GAETDDDRIQ | LLLSEVKGKD | 50 |
| Consensus | MKVVAAYLLA | VLGGNTSPSA | EDIKDILGSV | GA---DDDRIE | LLLSEVKGKD | 50 |
| CeresClone:953928 | VAELIAVGRE | KLASVPS-GG | GGVAMASAPS | AGGGGGAAPI- | AEDKKEEKKE | 98 |
| CeresClone:426736 | LAELIAAGRE | KLASVPSGGG | GGVAVASATS | GGGGGGAAPA | AESKKEEKKE | 100 |
| Lead-Lead118-CeresClone25429 | AELIASGRE | KLASVPS-GG | GVAVSAAPSS | CGGAAPA | AE-KKEAKKE | 98 |
| CeresClone:524682 | VELIAAGRE | KLATVPS-GG | GAVAVAAAP | GCCAAAAAPA | AEAKKEEKVE | 99 |
| CeresGdna:1488311 | TELIASGRE | KLASVPS-GC | GVAVAARGAP | AASGGAAPA | AEAKKEEKVE | 99 |
| CeresClone:1609735 | TELIASGRE | KLASVPS-GG | GGVAVAAAAC | GGGAAPAAAA | AESKKEERSK | 99 |
| gi\|42565379 | TELIASGRE | KFASVPS-GG | AALAVSAPAA | GGGAAPAAAA | AETKKEEKVE | 99 |
| gi\|24473796 | TELIASGRE | KLASVPS-GG | GAVAVAAPGA | GAGAA-APAA | AEPKKEEKVE | 98 |
| Consensus | ITELIASGRE | KLASVPS-GG | GGVAVAAAAS | GGGAA--AA--A | AE--KKEEKVE | 100 |
| CeresClone:953928 | EKEESDDDMG | FSLFE | | | | 113 |
| CeresClone:426736 | EKEESDDDMG | FSLFE | | | | 115 |
| Lead-Lead118-CeresClone25429 | EKEESDDDMG | FSLFE | | | | 113 |
| CeresClone:524682 | EKEESDDDMG | FSLFD | | | | 114 |
| CeresGdna:1488311 | EKEESDDDMG | FSLFD | | | | 114 |
| CeresClone:1609735 | R--------- | ------ | | | | 100 |
| gi\|42565379 | EKEESDEDMG | FSLFD | | | | 114 |
| gi\|24473796 | EKEDTDDDMG | FSLFD | | | | 113 |
| Consensus | EKEESDDDMG | FSLFD | | | | 115 |

Figure 2 (continued)

|  |  |  |  |  |  |  |
|---|---|---|---|---|---|---|
| gi\|55978016 | M P Q I Q Y S E K Y | Y D D V F E Y R H V | V L P P D I A K L L | P K N R L L T E T E | W R G L G V Q Q S R | 50 |
| CeresClone:947192 | M G Q I Q Y S D K Y | F D D T F E Y R H V | V L P P D T A K L L | P K N R L L S E N E | W R A I G V Q Q S R | 50 |
| gi\|27435806 | M G Q I Q Y S E K Y | L D D T F E Y R H V | V L P P E V A K L L | I K N R L L S E N E | W R A I G V Q Q S R | 50 |
| gi\|45935118 | M G Q I Q Y S E K Y | F D D T F E Y R H V | V L P P E V A K L L | P K N R L L S E N E | W R A I G V Q Q S R | 50 |
| Lead-Lead119-CeresClone5750 | M G Q I Q Y S E K Y | F D D T Y E Y R H V | V L P P E V A K L L | P K N R L L S E N E | W R A L G V Q Q S R | 50 |
| gi\|42362268 | M G Q I Q Y S E K Y | F D D T F E Y R H V | V L P P E V A K L L | P K N R L L A E N E | W R A L G V Q Q S R | 50 |
| CeresClone:1017141 | M G Q I Q Y S E K Y | F D D T F E Y R H V | V L P P E V A K L L | P K N R L L A E N E | W R A L G V Q Q S R | 50 |
| CeresClone:1448636 | M G Q I Q Y S E K Y | F D D T F E Y R H V | V L P P E V A K L L | P K N R L L S E N E | W R A I G V Q Q S R | 50 |
| gi\|50919707 | M G Q I Q Y S E K Y | F D D T Y E Y R H V | V L P P E V A K L L | P K N R L L S E N E | W R A I G V Q Q S R | 50 |

Consensus          M G Q I Q Y S E K Y    F D D T F E Y R H V    V L P P E V A K L L    P K N R L L S E N E    W R A I G V Q Q S R    50

|  |  |  |  |  |  |
|---|---|---|---|---|---|
| gi\|55978016 | G W V H Y A I H R P | E P H I M L Y R R P | L T E T P P Q — — | H A Q N — — V L A K | 77 |
| CeresClone:947192 | G W V H Y A I H R P | E P H I M L F R R T | N Y Q Q Q Q D Q A | — — — — — L V K | 88 |
| gi\|27435806 | G W V H Y A I H R P | E P H I M L F R R P | N Y Q Q Q Q D Q A | A Q L N — — L I A K | 83 |
| gi\|45935118 | G W V H Y A I H R P | E P H I M L F R R P | N Y Q Q Q Q E S Q | A Q N — — M L V K | 88 |
| Lead-Lead119-CeresClone5750 | G W V H Y A V H R P | E P H I M L F R R P | N Y Q Q Q Q E N Q | A Q Q S — M L V K | 87 |
| gi\|42362268 | G W V H Y A V H R P | E P H I M L F R R P | N Y Q Q Q Q E N Q | A A A A A Q M M P K | 88 |
| CeresClone:1017141 | G W V H Y A I H R P | E P H I M L F R R P | N Y Q Q Q Q D A A | A A A A A Q M M P K | 90 |
| CeresClone:1448636 | G W V H Y A I H R P | E P H I M L F R R P | N Y Q Q Q Q D A A | A A A A A Q M M P K | 90 |
| gi\|50919707 | G W V H Y A I H R P | E P H I M L F R R P | N F Q Q Q Q E A A | A A A A A Q M L P K | 90 |

Consensus          G W V H Y A I H R P    E P H I M L F R R P    L N Y Q Q Q Q E — —    A — — — — — M L — K    90

Figure 3

```
CeresGdna:1440705                                                                             0
CeresClone:1571117           MTTQQGPPAA SYSPARDGGG ------KAAAI DNWLP ------SATRNAKWW         50
Lead-Lead120-CeresClone218626 ------MGTQAP ENYPAEKVQD ARSAEDEEKE ---AIDDWLP ITSSRNAKWW        40
gi|30409136                  ---------- ---MAKQWWQD GRSAQEK--- ---AIDDWLP ITSSRNAKWW        32

Consensus                    ---------- ----PA---QD GRSA-EK--- ---AIDDWLP ITSSRNAKWW        50

CeresGdna:1440705            ---------M VGAGVLSLPY AMANLGWGPG TVILVLSWII TLYTLWQMVE         41
CeresClone:1571117           YSAFHNVTAM VGAGVLELPY AMSQLGWGAG TLIMLLSWVI TLYTLWQMVE        100
Lead-Lead120-CeresClone218626 YSAFHNVTAM VGAGVLSLPY AMSELGWGPG AVLVVSWVI TLYTLWQMVE         90
gi|30409136                  YSAFHNVTAM VGAGVLSLPY AMSELGWGPG AVLILSWII TLYTLWQMVE          82

Consensus                    YSAFHNVTAM VGAGVLSLPY AMSELGWGPG IA-LVLSWVI TLYTLWQMVE        100

CeresGdna:1440705            MHEMVPGKRF DRYHELGQHA FGEKLGLYIV VPQQLTCEVG VDIVYMVTGG         91
CeresClone:1571117           MHEMVPGKRF DRYHELGQHA FGDRLGLWIV VPQQLVVEVG VNIVYMVTGG        150
Lead-Lead120-CeresClone218626 MHEMVPGKRF DRYHELGQHA FCDRLGLWIV VPQQLVVEVG VNIVYMVTGG       140
gi|30409136                  MHEMVPGKRF DRYHELGQHA FGEKLGLWIV VPQQLVVEVG VNIVYMVTGG        132

Consensus                    MHEMVPGKRF DRYHELGQHA FG--LGLWIV VPQQLVVEVG VNIVYMVTGG        150

CeresGdna:1440705            KSLQKLHN-L VCKD------ CAPIKLTYFI MIFASVHFVL SHLPNFNSIS        134
CeresClone:1571117           TSLQKFHDVL VCGDAA-CEC GRKIRLTYFI MIFASCHFVL AQLPNFDSIS        199
Lead-Lead120-CeresClone218626 KSLKKFHDVL VCGDTGVCEC KDNIKLTYFI MIFASVHFVL SQLPNFNSIS        190
gi|30409136                  KSLKKFHDVL CEGH------G CKNIKLTYFI MIFASVHFVL SQLPNFNSIS        177

Consensus                    KSL-KFHDVL VCGD----CEC C-NIKLTYFI MIFASVHFVL SQLPNFNSIS        200

CeresGdna:1440705            GVSLAAAVMS LSYSTIAWSA SVHKGVQPDV DYGYKASTTS GLVFNFFSAL        184
CeresClone:1571117           GVSLAAAVMS LSYSTIAWGA SVSKGRVPDV DYGLRATTPP GKVFGFLCAL        249
Lead-Lead120-CeresClone218626 GVSLAAAVMS LSYSTIAWGA SVHKGRMSGV DYHLRATTTP GKVFGFGAL          240
gi|30409136                  GVSLAAAVMS LSYSTIAWGA SVDKGKVADV DYHLRATTST GKVFGFFSAL        227

Consensus                    GVSLAAAVMS LSYSTIAWGA SVHKGRV-DV DY-LRATTT- GKVFGFF-AL        250
```

Figure 4

| | | | | | | |
|---|---|---|---|---|---|---|
| CeresGdna:1440705 | GDVAFAYAGH | NVVLEI QATI | PSKPGKPSKG | PMWKGVVVAY | IVVALCYFPV | 234 |
| CeresClone:1571117 | GIVAFAYAGH | NVVLEI QATI | PSTPEKPSKK | PMWKGVVVAY | LVVALCYFPV | 299 |
| Lead-Lead120-CeresClone218626 | GDVAFAYAGH | NVVLEI QATI | PSTPDKPSKK | PMWKGVVVAY | VVVALCYFPV | 290 |
| gi|30409136 | GDVAFAYAGH | NVVLEI QATI | PSTPEKPSKK | PMWKGVVVAY | LIVALCYFPV | 277 |
| Consensus | GDVAFAYAGH | NVVLEI QATI | PSTPEKPSKK | PMWKGVVVAY | IVVALCYFPV | 300 |
| | | | | | | |
| CeresGdna:1440705 | ALIGYYMFGN | KVEDNILISL | EKPTWLIVAA | NMFVVIHVIG | SYQIYAIPVF | 284 |
| CeresClone:1571117 | SFVGYWAFGD | SVDGDILVTL | NRPRWLIALA | NMMVVHVIG | SYQIYAMPVF | 349 |
| Lead-Lead120-CeresClone218626 | ALIGYWAFGN | TVEDNILITL | SKPKWLIALA | NMMVVHVIG | SYQIYAMPVF | 340 |
| gi|30409136 | ALVGYWAFGN | HVDDNILITL | SRPKWLIALA | NMMVVIHVIG | SYQIYAMPVF | 327 |
| Consensus | AL-GYWAFGN | -V-DNILITL | S-PKWLIALA | NMMVVIHVIG | SYQIYAMPVF | 350 |
| | | | | | | |
| CeresGdna:1440705 | DMLETLLVKK | LHFRPSRKLR | FTLRNLYVAF | TMFVGICFPF | FGGLLGFFGG | 334 |
| CeresClone:1571117 | DMIETVLVKK | LRFPPGLTLR | LIARTVYVAF | TMFIAITFPF | FDGLLSFFGG | 399 |
| Lead-Lead120-CeresClone218626 | DMIETVLVKK | LRFPPGLTLR | LIARTLYVAF | TMFIAITFPF | FGGLLGFFGG | 390 |
| gi|30409136 | DMIETVLVKK | LRFPPGLTLR | LIARTLYVAF | TMFIAITFPF | FGGLLGFFGG | 377 |
| Consensus | DMIETVLVKK | LRFPPGLTLR | LIARTIYVAF | TMFIAITFPF | FGGLLGFFGG | 400 |
| | | | | | | |
| CeresGdna:1440705 | FAFAPTTYFL | PCIMWLAIYK | PKRFSLSWLT | NWCLDLRTNL | VSDSLFPMKR | 384 |
| CeresClone:1571117 | FAFAPTTYFL | PCIMWLAIYK | PKRFSLSWFT | NW-------- | ---------- | 431 |
| Lead-Lead120-CeresClone218626 | FAFAPTTYFL | PCVMWLAIYK | PKRFSLSWLT | NW-------- | ---------- | 422 |
| gi|30409136 | FAFAPTTYFL | PCIMWLAIYK | PRRFSLSWFT | NW-------- | ---------- | 409 |
| Consensus | FAFAPTTYFL | PCIMWLAIYK | PKRFSLSW-T | NW-------- | ---------- | 450 |
| | | | | | | |
| CeresGdna:1440705 | HGRNSGVTLI | SSTFCTGLGG | HDSSLSFSQL | ISRGFGRAYS | CNVDLVRFP | 434 |
| CeresClone:1571117 | ---------- | ----CIILG- | ---------- | ---------- | ---VLLMVLAP | 445 |
| Lead-Lead120-CeresClone218626 | ---------- | ----MCIILG- | ---------- | ---------- | ---VLLMILSP | 436 |
| gi|30409136 | ---------- | ----CIILG- | ---------- | ---------- | ---VMLMILSP | 423 |
| Consensus | ---------- | ---ICIILG- | ---------- | ---------- | --VLLM-LSP | 500 |

Figure 4 (continued)

```
Lead-CeresClone121021   ----------  ----------  ----------  ----KPVNPDGF  --------VT        28
CeresClone:1121512      MAEIPKLDLS  SSCFDNGEPL  PGQELGSGLQ  VSDHINAFQY  ADEKADSFVI        50
CeresGdna:1501628       ----------  --MDSSGGDGG  LLEETMEAQKLT VLDRLDGFQY  TKEKSDSFII        42

Consensus               ----------  SS--DNG--L  -------QKL-  -V-D-IDGFQY  --EK-DSF-I        50

Lead-CeresClone121021   DVESFSSVMH  KDFSSSSPRI  TLQRNVSRKG  SPRSNNER--  -KLHFDANGN        75
CeresClone:1121512      DMDAFSSGHN  KDATNANSRI  TLQRSLSRKG  SQRLGDWKLN  NNATLYDKDT       100
CeresGdna:1501628       DMESFSFGIN  KDI-NTNQRI  I--RNLSRKG  SPRGGGGG--  ----------        77

Consensus               DMESFSSGIN  KD--N-N-RI  TLQRNLSRKG  SPR-G-----  ----------       100

Lead-CeresClone121021   DKEISFPQSP  LRGSSTPEKA  SI--TVGPTEH  AGTATTAATA  VSASPLHQIT       123
CeresClone:1121512      VPACSPKXT  LVGPFTPEKP  AGMAVGPMGH  SMNPHVH---  -------N--       138
CeresGdna:1501628       ----------  --GPSTPEKA  AVVTVGTPDH  SSSPQVH---  ----HQIT--       106

Consensus               ---I---P--  L-GPSTPEKA  A--TVGP--H  S--P-VH---  ----HQIT        150

Lead-CeresClone121021   VTTAATAAGN  MITDQNRERR  FGFSRKSSFK  RSHTSWMLDP  KKIVLFFATL       173
CeresClone:1121512      LTADNIPT--  -----ESK---  CSITRRNSFR  RPSI-SWAIDP  KRVLLFFATL       178
CeresGdna:1501628       ITTGSING--  -------TPEGR  C--IRRNSFK  RASPSWVLDP  KRVLFFFATL       147

Consensus               -TT-I----  -------E-R  C---RRNSFK  R-S-SW-LDP  KRVLLFFATL       200

Lead-CeresClone121021   SSMGSILLI  FTLSISKSNP  GDMPLD        199
CeresClone:1121512      SSMGTMLLIY  FTLTISKQSA  EEYGG-        203
CeresGdna:1501628       SSMGTMLLIY  LTLSIGKLKT  D-----        168

Consensus               SSMGTMLLIY  FTLSISK---  ------        226
```

Figure 5

```
CeresClone:754061        MMMTQV-ANH SKRNHIDGYF SGKQQQQQQQ VGAATATSSG SEEFG--RMG    47
CeresClone:282892        MMMAEVAANH SKRSHNDGYF SAK------- -AAAAAAAS  PEELGSMSMS    41
gi|50925813              MMMTEV-ANH SKRNHNESYF -L-------- -GKAAVTSS  SEEFG---SMT   36
Lead-CeresClone158765    ---MEFSGDA GMMMENK--- ---------- -RNVCSLCE  S--------S    24
gi|5669656               -------MPHK ---MPHK--- ---------- -RSPISLEH  SSSLT----SLT 20
CeresClone:537752        MFSREEGIDV RKMMEHK--- ---------- -RRPCSVDQ  SSYT----SIA  32

Consensus                MMM-EV-ANH SKR-HNK-YF S--------- -R---AS-S- SEE-G--SM-   50

CeresClone:754061        SKKPRSASPR GSGGPISPRE KKDKVGERVA ALQQLVSPFG KTDTASVLQE   97
CeresClone:282892        SKKPRNSNSP RT-APVSPKE KKDRIGERVA ALQQLVSPFG KTDTASVLQE   90
gi|50925813              SKKPRNTSPR D--APVSPKE KKDKIGERVA ALQQLVSPFG KTDTASVLQE   84
Lead-CeresClone158765    IKRHKSD--- -LSFNSKE   RKDKVGERIS AQQIVSPYG  KTDTASVLD    68
gi|5669656               PKRLKAD--- -MLTSSKE   KKEKFGERIV APQQLVSPYG KTDTASVLLE   64
CeresClone:537752        SKRQKAD--- -LSISTKE   RKEKIGERIV ALQQLVSPYG KTDTSSVLKE   76

Consensus                SK-P---S-- -----LPIS-KE KKDKIGER-A ALQQLVSP-G KTDTASVLQE  100

CeresClone:754061        ASGYIKFLHQ QLEVLSSPYM RPPPAPGAEP EDPEHYSLRN RGLCLVPVEQ  147
CeresClone:282892        ASGYIRFLHQ QLQVLSSPYM RAPPAAGAAP EDTEHYSLRS RGLCLVPVDQ  140
gi|50925813              ASGYIKFLHQ QLEVLSSPYM RAPPVPGAAP EDPDHYSLRN RGLCLVPVDQ  134
Lead-CeresClone158765    AMHYIEFLHE QVKVLSAPYL QTI-PD---  -AT-Q       EELEQYSLRN  QGLCLVPMEN 116
gi|5669656               AMGYIKFLHE QVKVLSAPYL CTMPM---SKT QESQPYNLRS RGLCLVPVSY  112
CeresClone:537752        AMEYLGFLHK QVKLLSAPYL ESSPA---AKM QGVEPCSLRS RGLCLVPVSV  124

Consensus                A-GYIKFLHQ Q-KVLS-PY- R-PPA-GAKP ED-EHYSLR- RGLCLVPV-Q  150

CeresClone:754061        TLQLTQSNGA DLWAPANTSR RT-------- PFR------- ---------  169
CeresClone:282892        TLQLTQSNGA DLWAPANTTR RR-------- ---------- ---------  162
gi|50925813              TLQLTQSNGA DLWAPANTTR RR-------- ---------- ---------  156
Lead-CeresClone158765    TVGVAQSNGA DIWAPVKTPL SPAFSVTSQS PFR------- ---------  149
gi|5669656               TVGVATSNGA DIWAPIKTSQ SSSPE-NDV- ---------- ---------  140
CeresClone:537752        TIGVAESNGA DIWAPIKTIT SPKFE-KDVS QFH------- ---------  156

Consensus                TL---QSNGA D-WAP---TTR ---------- ---------- ---------  183
```

Figure 6

```
Lead-CeresClone16403  MAVSSLSIRC  GGFSPTISHK  TELCPNPSL   KACCLLSSGG  KADSSESTYQ  50
CeresClone:611156     MVVSSCSL--  SWSPCLSHK   LNLPHTN-CL  PRNIATSSSN  TVFCELDTTP  47
CeresGdna:1464944     MAISSSLSL-- SWASTTLSQK  LSVPGSNEIL  PRVAAFSGNN  SVTCTAEATF  48

Consensus             MAVSSLSL--  SW-SPTLSHK  L---P---N---L  PR---A-SS-N  -V--C---TT-  50

Lead-CeresClone16403  KGSGNNWKRR  QALVGVGLLV  ATSPAILL    AEEIPKSYSP  FVDREDGYSY  100
CeresClone:611156     SGESHC-RRR  PLLLGIGALT  ANLQPTNLVF  AQEKDRYRA   FVDYEDGYSY  96
CeresGdna:1464944     NEESNC-KRR  LLLGVGALT   TSLVPANFLF  AEEIPKNYTS  FVDFEDGYSY  97

Consensus             -GESNC-KRR  -LLLGVGALT  A-L-PANLLF  AEEIPK-Y--  FVD-EDGYSY  100

Lead-CeresClone16403  YYPSDWREFD  FRAHDSAFKD  RYLQLQNVRV  RFIPTEKNDI  HEVGPMEEVV  150
CeresClone:611156     VYPDWKEFD   FRAHDSAFKD  RYLQLQNVRV  RFIPTEKKDI  RDLGPMEEVI  146
CeresGdna:1464944     YYPSDWDFD   FRGHDSAFKD  RTKQLQNVRV  RFIPTEKKDI  HELGPMEE--  145

Consensus             YYPSDW-EFD  FRAHDSAFKD  RYLQLQNVRV  RFIPTEKKDI  HELGPMEEV-  150

Lead-CeresClone16403  YDLVKHKFAA  PNQVATIYDM  KERVEDGKNY  YTFEYGLRTP  IYATTSFATV  200
CeresClone:611156     YDLVKHRYAA  PNQRPTINDM  QEKTIDGKHY  YTFEYILTSP  NYSSASFATI  196
CeresGdna:1464944     YDSHMQQEIM  NVKLSNFLE-  NQKTVEGKNY  YTFEYELTSP  NYSSVSFATI  194

Consensus             YDLVKH--AA  PNQ--TI-DM  -EKT-DGKNY  YTFEY-LTSP  NYSS-SFATI  200

Lead-CeresClone16403  AVGNNRYYTL  IVGANERRWR  RVKKQLQVVA  DSLKILQI    238
CeresClone:611156     AIGNGRYYTL  IVGANERRWK  RFRDQLKVVA  DSFRLLDI    234
CeresGdna:1464944     VLANGRFYTL  IVGANERRWR  RYRSQLKVVA  DSFKVLDI    232

Consensus             AIGNGRYYTL  IVGANERRWR  R-R-QLKVVA  DSFK-LDI    238
```

Figure 7

| | | | | | |
|---|---|---|---|---|---|
| Lead-CeresClone28635 | MGSLGTMLRY | PDDLYPLLKM | KRALEKAEKQ | PPEPHWCFC | YSMLHKVSRS | 50 |
| gi\|38426486 | -SSLKAVLKH | PDDFYPLLKL | KMAAKKAEKQ | PSQPHWAFS | YSMLHKVSRS | 49 |
| CeresGdna:1514021 | | | -MAAKHAAKQ | PSEPHWAFC | YSMLHRVSRS | 29 |
| gi\|55710094 | MGSLGAILKH | PDDFYPLLKL | KMAARHAEKQ | PPEPHWAFC | YSMLHKVSRS | 50 |
| gi\|75859951 | MGSLGAILKH | PDDFYPLLKL | KFAARHAEKQ | PPEPHWAFC | YSMLHKVSRS | 50 |
| gi\|41224629 | MGSLGAILKH | PEDFYPLLKL | KFAARHAEKQ | PPEPHWAFC | YSMLHKVSRS | 50 |
| gi\|27475614 | MGSIKAILKN | PDDFFPLLKL | KIAARNAEKQ | PPEPHWAFC | YSMLHKVSRS | 50 |
| gi\|28208268 | MGSLGAILKH | PDDLYPLLKL | KMAARHAEKQ | PPEPHWAFC | YSMLHKVSRS | 50 |
| gi\|1449163 | MGSLGAIVRH | PDEVYPLLKL | PSEPHWAFC | YSMLHKVSRS | 50 | |
| gi\|2463569 | MGSLGAILKH | PDDFYPLLKL | KMAARNAEKQ | PAEPHWAFC | YTMLHKVSRS | 50 |
| | | | | PPEPHWAFC | YTMLHKVSRS | 50 |
| Consensus | MGSLGAILKH | PDDFYPLLKL | KMAARHAEKQ | PPEPHWAFC | YSMLHKVSRS | 50 |

| | | | | | |
|---|---|---|---|---|---|
| Lead-CeresClone28635 | FSLVIQQLNT | ELRNAVCVFY | LVLRALDTVE | DDTSIPLDEK | VPILIAFHRH | 100 |
| gi\|38426486 | FALVIQQLNP | QLRDAVCIFY | LVLRALDTVE | DDTSIAADIK | VPILIAFHKH | 99 |
| CeresGdna:1514021 | FAFVIQQLGT | ELRNAVCIFY | LVLRALDTVE | DDTSIPTDVK | VPILKAFHRH | 79 |
| gi\|55710094 | FGLVIQQLGP | QLRDAVCIFY | LVLRALDTVE | DDTSISTEVK | VPILMAFHRH | 100 |
| gi\|75859951 | FGLVIQQLGP | QLRDAVCIFY | LVLRALDTVE | DDTSIPTEVK | VPILMAFHRH | 100 |
| gi\|41224629 | FGLVIQQLGP | ELRDAVCIFY | LVLRALDTVE | DDTSIPTEVK | VPILIDFHRH | 100 |
| gi\|27475614 | FALVIQQLDT | DLRNAVCIFY | LVLRALDTVE | DDTSIEIDVK | VPILIDFHRH | 100 |
| gi\|28208268 | FGLVIQQLGP | QLRNAVCIFY | LVLRALDTVE | DDTSIATDVK | EPILIAFHRH | 100 |
| gi\|1449163 | FALVIQQLDP | ELRNAVCIFY | LVLRALDTVE | DDTSIETDVK | VPILIAFHRH | 100 |
| gi\|2463569 | FALVIQQLGI | | LVLRALDTVE | DDTSIETDVK | VPILIAFHRH | 100 |
| Consensus | FALVIQQLGP | QLR-AVCIFY | LVLRALDTVE | DDTSI-TDVK | VPILIAFHRH | 100 |

| | | | | | |
|---|---|---|---|---|---|
| Lead-CeresClone28635 | YDLDWHYSC | GTKEYKILMD | QFHHVSAAFL | ELEKGYQEAI | EEITRRMGAG | 150 |
| gi\|38426486 | YNRDWHFAC | GTKEYKVLMD | QFHHVSTAFL | ELKRGYQEAI | EDITMRMGAG | 149 |
| CeresGdna:1514021 | YDRNWHFSC | GTNDYRVLMD | QFHDVSTAFL | ELEKGYKEAI | EDITKRMGAG | 129 |
| gi\|55710094 | YDNNWHFSC | GTKEYKILMD | EFHHVSNAFL | ELGNGYQEAI | EDITMRMGAG | 150 |
| gi\|75859951 | YDKDWHFSC | GTKEYKVLMD | EFHHVSNAFL | ELGNGYQEAI | EDITMRMGAG | 150 |
| gi\|41224629 | YDKDWHFSC | GTKEYKVLMD | EFHHVSKAFL | ELGKNYQDAI | EDITKRMGAG | 150 |
| gi\|27475614 | YDNDWHFCC | GTKEYKVLMD | QFHLVSTAFL | ELAKNYQAI | EDITDRMGAG | 150 |
| gi\|28208268 | YDRDWHFSC | GTKEYKVLMG | QFHHVSTAFL | ELEKNYQAI | ENITKEMGAG | 150 |
| gi\|1449163 | YDRDWHFSC | GTKEYKVLMD | QFHHVSTAFL | ELGKNYQEAI | EDITKRMGAG | 150 |
| gi\|2463569 | YDRDWHFSC | GTKEYKVLMD | QFHHVSTAFL | ELGKNYQEAI | EDITKRMGAG | 150 |
| Consensus | YDRDWHFSC | GTKEYKVLMD | QFHHVSTAFL | ELGKGYQEAI | EDITKRMGAG | 150 |

Figure 8

| | | | | | |
|---|---|---|---|---|---|
| Lead-CeresClone28635 | MAKFICQEVE | TVDDYDEYCH | YVAGLVGLGL | SKLFLAAGSE | VLTPDMEATS | 200 |
| gi\|38426486 | MAKFICKEVE | TVDDYDEYCH | YVAGLVGIGL | SKLFHSSCTE | ILFSD--SIS | 197 |
| CeresGdna:1514021 | MAKFICKEVE | TIDDYDEYCH | YVAGLVGLGL | SKLFHASELE | DLASD--SLS | 177 |
| gi\|55710094 | MAKFICKEVE | TIDDYDEYCH | YVAGLVGLGL | SKLFHASGAE | DLASD--SLS | 198 |
| gi\|75859951 | MAKFICKEVE | TIDDYDEYCH | YVAGLVGLGL | SKLFHASGAE | DLATD--SLS | 198 |
| gi\|41224629 | MAKFICKEVE | TINDYDEYCH | YVAGLVGLGL | SKLFHASCAE | DLATD--SLS | 198 |
| gi\|27475614 | MAKFICKEVE | TVDDYDEYCH | YVAGLVGLGL | SKLFYASGKE | DLATD--KLS | 198 |
| gi\|28208268 | MAKFICKEVE | TVDDYDEYCH | YVAGLVGLGL | SKLFHASCKE | NLAAD--SLS | 198 |
| gi\|1449163 | MAKFICNEVE | TVDDYDEYCH | YVAGLVGLGL | SKLFHASGKE | DLAPD--HLS | 198 |
| gi\|2463569 | MAKFICKEVE | TIDDYDEYCH | YVAGLVGLGL | SKLFHASGSE | DLAPD--DLS | 198 |
| Consensus | MAKFICKEVE | TIDDYDEYCH | YVAGLVGLGL | SKLFHASG-E | DLA-D---SLS | 200 |
| Lead-CeresClone28635 | NSMGLFLQKT | NIIRDYLEDI | NEIPKSRMFW | PREIWGKYAD | KLEDLKYEEN | 250 |
| gi\|38426486 | NSMGLFLQKT | NIIRDYLEDI | NEIPKSRMFW | PREIWSKYVN | KLEDLKYEEN | 247 |
| CeresGdna:1514021 | NSMGLFLQKT | NIIRDYLEDI | NEIPMSRMFW | PRKIWNKYVN | KLEDLKYEEN | 227 |
| gi\|55710094 | NSMGLFLQKT | NIIRDYLEDI | NEIPKSRMFW | PRKIWNKYVN | KLEDLKYEEN | 248 |
| gi\|75859951 | NSMGLFLQKT | NIIRDYLEDI | NEIPKSRMFW | PRQIWSKYVD | KLEDLKYEEN | 248 |
| gi\|41224629 | NSMGLFLQKT | NIIRDYLEDI | NEIPKSRMFW | PRQIWSKYVD | KLEDLKYEEN | 248 |
| gi\|27475614 | NSMGLFLQKT | NIIRDYLEDI | NEIPKSRMFW | PRQIWSKYVS | KLEDLKYEEN | 248 |
| gi\|28208268 | NSMGLFLQKT | NIIRDYLEDI | NEIPKSRMFW | PRQIWSKYVN | KLEDLKYEEN | 248 |
| gi\|1449163 | NSMGLFLQKT | NIIRDYLEDI | NEIPKSRMFW | PRQIWSKYVN | KLEDLKYEEN | 248 |
| gi\|2463569 | NSMGLFLQKT | NIIRDYLEDI | NEIPKSRMFW | PRQIWSEYVN | KLEDLKYEEN | 248 |
| Consensus | NSMGLFLQKT | NIIRDYLEDI | NEIPKSRMFW | PRQIWSKYVN | KLEDLKYEEN | 250 |
| Lead-CeresClone28635 | TNKSVQCLNE | MVTNAL-HAE | DCLKYMVSLR | DPSIFRFCAI | PQIMAIGTLA | 300 |
| gi\|38426486 | SEKAVQCLND | MVTNALIHD | DCLKYMSQLK | DPAIFRFCAI | PQIMAIGTLA | 297 |
| CeresGdna:1514021 | SVEAVQCLND | MVTNSLIHVD | DCLKYMSDLR | EPAIFRFCAI | PQVMAIGTLA | 277 |
| gi\|55710094 | SVKAVQCLND | MVTNALLHVE | DCLKYMSDLR | DPAIFRFCAI | PQIMAIGTLA | 298 |
| gi\|75859951 | SAKAVRCLND | MVTNALVHAE | DCLKYMSDLR | DPAIFRFCAI | PQIMAIGTLA | 298 |
| gi\|41224629 | SAKAVQCLND | MVTDALVHAE | DCLKYMSDLR | GPAIFRFCAI | PQIMAIGTLA | 298 |
| gi\|27475614 | SVKAVQCLND | MVTNALLHAD | DCLQYMSALR | DSSNFRFCAI | PQVMAIGTLA | 298 |
| gi\|28208268 | SVKAVQCLND | MVTNALMHAE | DCLKYMSALR | DMSIFRFCAI | PQIMAIGTLA | 298 |
| gi\|1449163 | SVKAVQCLND | MVTNALLHAE | DCLKYMSDLR | DPPIFRFCAI | PQIMAIGTLA | 298 |
| gi\|2463569 | SVKAVQCLND | MVTNALMHPE | DCLKYMAALR | DPPLFRFCAI | PQIMAIGTLA | 298 |
| Consensus | SVKAVQCLND | MVTNAL-HAE | DCLKYMSALR | DPAIFRFCAI | PQIMAIGTLA | 300 |

Figure 8 (continued)

| | | | | | | |
|---|---|---|---|---|---|---|
| Lead-CeresClone28635 | LCYNNEQVFR | GVVKLRRGLT | AKVIDRTKTM | ADVYGAFYDF | SCMLKTKVDK | 350 |
| gi\|38426486 | LCYNNIEVFR | GVVKLRRGLT | AKVIDRTKTM | ADVYQAFSDF | SDMLKSKVDM | 347 |
| CeresGdna:1514021 | MCYNNINVFR | GVVKMRRGLT | AQIFHRTKTM | ADVYGAFFDF | SCMLKSKVDR | 327 |
| gi\|55710094 | LCYNNLQVFR | GVVKMRRGLT | AKVIDRTNKM | SDVYGAFYDF | SCMLKTKVDN | 348 |
| gi\|75859951 | LCFNNITQVFR | GVVKMRRGLT | AKVIDRTKTM | SDVYGAFFDF | SCLLKSKVDN | 348 |
| gi\|41224629 | LCFNNITQVFR | GVVKMRRGLT | AKVIDQTKTM | ADVYGAFFDF | SCLLKSKVDK | 348 |
| gi\|27475614 | MCYNNIGVFR | GVVKMRRGLT | AKVIDRTKTI | ADVYGAFFDF | ASVLESKVDK | 348 |
| gi\|28208268 | LCYNNVEVFR | GVVKMRRGLT | AKVIDRTKTM | ADVYGAFFDF | ASMLESKVDK | 348 |
| gi\|1449163 | LCYNNIEVFR | GVVKMRRGLT | AKVIDRTKTM | ADVYGAFFDF | SCMLKSKVDK | 348 |
| gi\|2463569 | LCYNNIEVFR | GVVKMRRGLT | AKVIDRTKTM | ADVYGAFFDF | ASMLEPKVDK | 348 |
| Consensus | LCYNNI -VFR | GVVKMRRGLT | AKVIDRTKTM | ADVYGAFFDF | SCMLKSKVDK | 350 |
| | | | | | | |
| Lead-CeresClone28635 | NDPNASKTLN | RLEAVQKLCR | DAGVLQ-NRK | SYVNDK---- | -----GQPNSVF | 392 |
| gi\|38426486 | HDPNAQTITT | RLEAAQKLCK | DSGTLS-NRK | SYIVKRE--- | -----SSYSAAL | 390 |
| CeresGdna:1514021 | NDPNATKTLS | SLEAVQKTCR | ESGALN-KRM | VDFLNSPVCV | WMMAGYTTSAC | 376 |
| gi\|55710094 | NDPNATKTLS | RLEAIQKKCR | ESGVITPNRK | SYVLEND--- | -----SGYNLV | 392 |
| gi\|75859951 | NDPNATKTLS | RLEAIQKTCR | ESGTLS-KRK | SYIIESE--- | -----SGHNSAL | 391 |
| gi\|41224629 | NDPNATKTLS | RLEAIQKTCR | ESGTLS-KRK | SYIIESE--- | -----SGHNSAL | 391 |
| gi\|27475614 | NDPNATKTLSS | RLEAIQKTCR | ESGLLT-KRK | SYVLRNE--- | -----SGYGSTM | 391 |
| gi\|28208268 | NDPNATKTLS | RLVAIQKTCR | ESGLLS-KRK | SYILRKE--- | -----NGYGSTI | 391 |
| gi\|1449163 | NDPNATKTLS | RLEAIQKTCR | ESGLLS-KRK | PYILRNE--- | -----STNSSTM | 391 |
| gi\|2463569 | NDPNATKTLS | RLEAIQKTCR | ESGLLS-KRK | SYIVNDE--- | -----SGYGSTM | 391 |
| Consensus | NDPNATKTLS | RLEAIQKTCR | ESGLLS-KRK | SYIL---E--- | -----SGY-S-L | 400 |
| | | | | | | |
| Lead-CeresClone28635 | IMVVILLAI | VFAYLRAN-- | ---- | | | 410 |
| gi\|38426486 | LALLFTLAI | LYAYLSANRP | IKI-- | | | 413 |
| CeresGdna:1514021 | SIPWKLLFL- | ---------- | ---- | | | 385 |
| gi\|55710094 | IALLFILAI | VYAYLSSNLS | NNR-- | | | 415 |
| gi\|75859951 | IALIFILAI | LYAYLSSNLL | PNKQ | | | 415 |
| gi\|41224629 | IAEIFILAI | LYAYLSSNLL | LNKQ | | | 415 |
| gi\|27475614 | ILLVILFSI | FAYLSANRH | NN--- | | | 413 |
| gi\|28208268 | LVLLVLLFSI | MFAYSEANRH | SN--- | | | 413 |
| gi\|1449163 | VLILVILSI | FAYLSAKRQ | DN--- | | | 413 |
| gi\|2463569 | VILVIMVSI | FAYLSANHH | NS--- | | | 413 |
| Consensus | IILVIILAI | -YAYLSAN-- | NN--- | | | 424 |

| | | | |
|---|---|---|---|
| gi\|4100646.T | CLDILKEQW | SPALTVSKV | --------- | 102 |
| gi\|52851174.T | CLDILKDQW | SPALTISKV | --------- | 102 |
| gi\|54402104.T | CLDILKEQW | SPALTVSKV | --------- | 102 |
| gi\|30025160.T | CLDILKDQW | SPALTISKV | --------- | 102 |
| Clone:617835.T | CLDILKDQW | SPALTISKV | --------- | 102 |
| Gdna:14833290.T | CLDILKEQW | SPALTISKV | --------- | 119 |
| gi\|22597164.T | CLDILKEQW | SPALTISKG | --------- | 102 |
| gi\|441457.T | CLDILKEQW | SPALTISKV | --------- | 102 |
| Clone:1380019.T | CLDILKEQW | SPALTISKV | --------- | 109 |
| Lead:Clone35698 | CLDILKEQW | SPALTISKVC | FRYVHC | 102 |
| gi\|5762457.T | CLDILKEQW | SPALTISKV | --------- | 102 |
| gi\|50906823.T | CLDILKEQW | SPALTISKV | --------- | 102 |
| gi\|774I6935.T | CLDILKEQW | SPALTISKV | --------- | 102 |
| gi\|40287554.T | CLDILKEQW | SPALTISKV | --------- | 102 |
| gi\|28569265.T | CLDILKEQW | SPALTISKV | --------- | 102 |
| gi\|28569267.T | CLDILKEQW | SPALTISKV | --------- | 102 |
| Consensus | CLDILKEQW | SPALTISKV | --------- | 126 |

```
Lead-CeresClone36412    RRVGLER--E  AQDKAERRRR  R------MCR  NCGEEESCVL  LLPCRHLCLC  331
CeresGdna:1467033       ERCTLAN--G  AQDNNGAGPR  GTGTSSWLCR  NCNKAESCVL  LLPCRHLCLC  284
CeresClone:1641329      GWRTLAGCAG  VKDKEGGGNG  R------LCR  NCRKEESCVL  LPCRHLCLC   283

Consensus               -R-TLA----G  AQDK-G-G-R  R-------LCR  NC-KEESCVL  LLPCRHLCLC  350

Lead-CeresClone36412    GVCGSSVHTC  PICLSPKNAS  VHVNMSS     358
CeresGdna:1467033       TVCGSSLHTC  PICKATKNAS  VHVNLS-     310
CeresClone:1641329      TVCGSSLHTC  PICKSYKTAS  VHVNMS-     309

Consensus               TVCGSSLHTC  PICKS-KNAS  VHVNMS-     377
```

Figure 10 (continued)

| | | | | | |
|---|---|---|---|---|---|
| CeresClone:359934 | ---------- | ---------- | ---------- | ---------- | 29 |
| gi|29371519 | ----MQGE | VDQPMQMVLR | ----MQIV | CVRSA---ST | 41 |
| CeresClone:839270 | ---------- | ---------- | ----MQMVLR | VKHPS---SL | 31 |
| gi|45935148 | MASPKQVMME | QQQPQLQLP | TTTNEATTQP | VKHPSGVISY | 49 |
| Lead-CeresClone4829 | -------M | TTTNEATTQP | PQQMM---- | LLKNSGVI--SY | 36 |
| CeresGdna:1485102 | ---------- | ---------- | ---------- | ---------- | 13 |
| CeresClone:1646533 | -------M | QSENQNNQLV | ---------- | SL | 36 |

Consensus        -----------M-L--V-----S------SL             50

| | | | | | |
|---|---|---|---|---|---|
| CeresClone:359934 | SLFKEKEEEI | ERKKVEVRDK | VFSMLGRVEE | ETKRLAFLRQ | 79 |
| gi|29371519 | SVFKAKEEQI | ERKKMEVRDK | VFAQLGRVEE | ESKRLAFLRQ | 91 |
| CeresClone:839270 | SVFKAKEEQI | ERKKMEVRDK | VFAQLGRMEE | ESKRLAFLRE | 81 |
| gi|45935148 | STFRAKEEEI | ERRRKEVTDR | VKAQLGRMEE | ESKRLAEIRE | 99 |
| Lead-CeresClone4829 | SAFRAKEDEI | EKRKMEVRER | VKAQLGRVEE | ETRRLASIRE | 86 |
| CeresGdna:1485102 | STFRAKEEEI | EKKKMEVREK | VKAQLGRVEE | ETKRLAMLRE | 63 |
| CeresClone:1646533 | STFRAKEEEI | ERKKMEVREK | VQLQLGRVEE | ETKRLATLRE | 86 |

Consensus        S-FRAKEEEI  ERKKMEVRDK  VQAQLGRVEE  ETKRLA-IRE            100

| | | | | | |
|---|---|---|---|---|---|
| CeresClone:359934 | REVDAIRKRI | DKVNRQLKPL | GKTCLKKEKE | YKMCLEAYNE | 129 |
| gi|29371519 | KEVEVIRKRI | DWVNRQLKPL | GKTCLVKKEKE | YKEILEAYNE | 141 |
| CeresClone:839270 | KEVESIORRI | DTVNRQLKPFX | SKXXVKKEKE | XKEIXEXYNE | 131 |
| gi|45935148 | KEAAMVRKKI | DVVTRELKSL | GOTCORKEKE | YKEITDAFNG | 149 |
| Lead-CeresClone4829 | KEVNIMVRKKI | DSVNKELKPL | GSIVQKKERE | YKEALDIFNE | 136 |
| CeresGdna:1485102 | KEVAVVRKKI | DTVNKELKPL | GHTVQKKEKE | YKDALEAFND | 113 |
| CeresClone:1646533 | KEVALVRKRI | DSVNKELKPL | GHTCQKKEKE | YKDALEAFNE | 136 |

Consensus        KEV-MVRKRI  D-VNRELKPL  GKTCQKKEKE  YKE-LEAYNE            150

| | | | | | |
|---|---|---|---|---|---|
| CeresClone:359934 | RLLE---- | ESERLRMKKL | EELNKILESL | Y--------- | 157 |
| gi|29371519 | RLIE---- | ESERMRMKKL | EELNKLVDSL | Y--------- | 169 |
| CeresClone:839270 | RLIE---- | ESXRMRXKKL | EELNKXXVDX | X--------- | 159 |
| gi|45935148 | KLME---- | ESERMRMKKL | EELSKNVESL | C--------- | 177 |
| Lead-CeresClone4829 | KLMEMGQLVG | ESEKLRLKKL | DELSRSIDTE | SESISQDKTI | PIKN | 180 |
| CeresGdna:1485102 | KLME---- | ESERLRLKKL | EELSKNIDSM | H--------- | 141 |
| CeresClone:1646533 | KLME---- | ESERLRMKKL | EELSKNIDSI | Q--------- | 164 |

Consensus        KLME-----LVS  ESERMRMKKL  EELNK-IDSL                        194

Figure 11

```
Lead-CeresClone5426    MATVPGQLIW  EIVKRNNCFL  VKQFGRGNAK  VQFSKESNNL  VNINSYKHSG   50
CeresClone:1123542     MATVPGQLIW  EIVKTNNCFL  VKQFGRGNAK  VQFSKETNNL  CNLNSYKHSG   50
CeresGdna:1499194      MATVPGQLIW  EIVKKNNCFL  VKQFGRGTAS  LRFSKESNNL  YNLNSYKHSG   50
CeresClone:557065      MATVPGQLIW  EVVKKNNSFL  VKEFGRGTQS  VQFSREPNNL  YNLNTFKYSG   50

Consensus              MATVPGQLIW  EIVKKNNCFL  VKQFGRG-A-  VQFSKESNNL  YNLNSYKHSG   50

Lead-CeresClone5426    LANKKTVTIQ  AAGKDQGVVL  GTTKTKRQNK  PKLSVNKSIL  KKEFSRMSKV  100
CeresClone:1123542     LANKKTVTIQ  AADKEQGVVL  ATTKTKKQNK  PKVSVNKSIL  KKEFSRMSKA  100
CeresGdna:1499194      LANKKTVTIQ  AGKDQAVVL   ATSKTKKQNK  PAALFHKSVM  KKEFRRMAKA  100
CeresClone:557065      LANKKTVTVQ  PAGKDQSVLL  ATTKTKKQNK  PAALLHKSVM  KKEFRRMAKA  100

Consensus              LANKKTVTIQ  AA-KDQ-VVL  ATTKTKKQNK  P----V-KS-- KKEF-RM-KA  100

Lead-CeresClone5426    VANQVVDNYY  RPDLKKAALA  RLSAISKGLR  VAKSGPKRRN  RQA         143
CeresClone:1123542     VANQVVDNYY  RPDLKKFALA  RLSVISKSLR  VAKSG------ ---         135
CeresGdna:1499194      VENQVEGNYY  RPDLKKAALA  RLSAVHRSLK  VAKSGVKKRN  RQGLRNFKHG  150
CeresClone:557065      VQNQVADNYY  RPDLKKAALA  RLSAVNRSLR  VAKSGVKKRN  RQAVK---    145

Consensus              V-NQVVDNYY  RPDLKKAALA  RLSA-S-SLR  VAKSGVKKRN  RQA         150

Lead-CeresClone5426    ----------  ----------                                       143
CeresClone:1123542     ----------  ----------                                       135
CeresGdna:1499194      HRNELIGLIF  KACYKNK                                          167
CeresClone:557065      ----------  --VPSRK                                          150

Consensus              ----------  -------K                                          167
```

Figure 12

| | | | | | | |
|---|---|---|---|---|---|---|
| gi\|21319 | MAGRNTKNG- | -ENNKIAGSS | LHLEKNPTTP | P--------- | ---------- | EAEATIKKLG | 39 |
| gi\|5823000 | MEGRNVKNGD | TNNNKIVGSS | LSIEKNPISP | P--------- | ---------- | -EASSIKKLA | 40 |
| gi\|439294 | ----MENG- | -TKREGLGKL | TVSSSLQVEQ | P--------- | ---------- | LAPSKLMKI I | 34 |
| gi\|575351 | ----MENG- | -TKKLNV--- | --SSLAVEQ | P--------- | ---------- | LPKSKLMKI I | 28 |
| Lead-CeresClone7894 | MVSHPMEKA- | -ANGASA--- | LETQTGELDQ | P--------- | ---------- | ---ERLRKI I | 33 |
| gi\|18091781 | ----MEKG- | -SNGSAA--- | LEMQTSELDQ | P--------- | ---------- | ---AAIRKI I | 28 |
| gi\|415988 | ----MENS- | -NRGVGA--- | -KTIITTTPP | P--------- | ---------- | EEAAPIRNIF | 30 |
| gi\|6120115 | ----MENG- | -DHRTAP--- | -AFQLQQASP | P--------- | ---------- | -EAAPVRNI- | 29 |
| gi\|17447420 | ----MELA- | ---------- | -NEAKSTALP | P--------- | ---------- | AQAAPVKNI- | 24 |
| gi\|68161544 | ----MELV- | -KPSSVF--- | -AIQDHQSSS | P--------- | ---------- | --PTPIWKTV | 28 |
| gi\|518863031 | ----MEVE- | -SANKDM--- | -RA------- | P--------- | ---------- | AQRSTI-RIV | 22 |
| gi\|33620334 | ----MEPF- | -SSTKQN--- | -HNNNNTLTK | P-SLHVESPP | ---------- | LEPSPLRKI I | 38 |
| gi\|5230818 | ----MEPL- | -SSTKQI--- | -NNNNNNLAK | PSSLHVETQP | ---------- | LEPSPLRKI M | 39 |
| gi\|1935019 | ----MEPL- | -SSTKQI--- | --NNNNNLAK | PSSLHVETQP | ---------- | LEPSPLRKI M | 38 |
| gi\|7649151 | ----METQ- | -LATKNP--- | --SSQPPPP | PPELAA---- | ---------- | PPSSNLKKI V | 33 |
| gi\|468562 | ----MQSST | SKENKQP--- | --PSSQPHP | PPLMVAGAAE | ---------- | PNSSPLRKVV | 39 |
| CeresGdna:1479767 | ---------- | ---------- | ---------- | ---------- | ---------- | ---------- | 0 |
| Consensus | ----ME--- | -S---K--- | ---SN---- | P--------- | ---------- | ----S-LRKI I | 50 |

| | | | | | | |
|---|---|---|---|---|---|---|
| gi\|21319 | LVASVAAGVQ | FGWALQLSLL | TPYVQLLGI P | HTWAAYI WLC | GPI SGMI VQP | 89 |
| gi\|5823000 | LVASI AAGVQ | FGWALQLSLL | TPYVQLLGI P | HTWAPYI WLC | GPI SGMI VQP | 90 |
| gi\|439294 | VVASI AAGVQ | FGWALQLSLL | TPYVQLLGI P | HKFASFI WLC | GPI SGMI VQP | 84 |
| gi\|575351 | MVASI AAGVQ | FGWALQLSLL | TPYVQLLGI P | HKFASFI WLC | GPI SGMI VQP | 78 |
| Lead-CeresClone7894 | SVSSI AAGVQ | FGWALQLSLL | TPYVQLLGI P | HKWASLI WLC | GPI SGMI VQP | 83 |
| gi\|18091781 | SVSSI AAGVQ | FGWALQLSLL | TPYVQLLGI P | HKWASYI WLC | GPI SGMI VQP | 78 |
| gi\|415988 | LVAAI AAGVQ | FGWALQLSLL | TPYVQLLGI P | HTWAFI WLC | GPI SGMI VQP | 80 |
| gi\|6120115 | LVAAI AAGVQ | FGWALQLSLL | TPYVQLLGI P | HVWAAFI WLC | GPVSGMI VQP | 79 |
| gi\|17447420 | VVASI AAGVQ | FGWALQLSLL | TPYVQLLGVP | HKWAAFI WLC | GPI SGLLVQP | 74 |
| gi\|68161544 | VVASI AAGI Q | FGWALQLSLL | TPYVQLLGI P | HTWAAFI WLC | GPI SGMI VQP | 78 |
| gi\|518863031 | VVASI AAGVQ | FGWALQLSLL | TPYVQLLGI T | HTWAAYI WLC | GPI SGMI VQP | 72 |
| gi\|33620334 | LVASI AAGVQ | FGWALQLSLL | TPYVQLLGI P | HTWAAYI WLC | GPI SGMLVQP | 88 |
| gi\|5230818 | VVASI AAGVQ | FGWALQLSLL | TPYVQLLGI P | HTWAAYI WLC | GPI SGMLVQP | 89 |
| gi\|1935019 | VVASI AAGVQ | FGWALQLSLL | TPYVQLLGI P | HTWAAFI WLC | GPI SGMLVQP | 88 |
| gi\|7649151 | VVASI AAGI Q | FGWALQLSLL | TPYVQLLGI P | HTWAAFI WLC | GPI SGLLVQP | 83 |
| gi\|468562 | MVASI AAGVQ | FGWALQLSLL | TPYVQLLGI P | HTWAAFI WLC | GPI SGMLVQP | 89 |
| CeresGdna:1479767 | ---------- | ---------- | ---------- | ---------- | ---------- | 50 |
| Consensus | VVASI AAGVQ | FGWALQLSLL | TPYVQLLGI P | HTWAAFI WLC | GPI SGMLVQP | 100 |

Figure 13

| | | | | | | |
|---|---|---|---|---|---|---|
| gi\|21319 | LVGYYSDRCT | SRFGRRRPFI | AAGAA-LVAVA | VGLI GFAADI | GAASGDPTGN | 139 |
| gi\|5823000 | TVGYYSDRCT | SKFGRRRSPFI | AVGA-LVGFA | VSLI GFAADI | GHATGDPNGN | 140 |
| gi\|439294 | VVGYYSDNCS | SRFGRRRPFI | AAGAA-LVMI A | VFLI GFAADL | GHASGDTLGK | 134 |
| gi\|575351 | VVGYYSDNCS | SRFGRRRGFI | AAGAA-LVTI A | VFLI GFAADI | GHATGDPLGK | 128 |
| Lead-CeresClone7894 | VVGYHSDRCT | SRFGRRRPFI | VAGAGL-VTVA | VFLI GYAADI | GHSMGDQLDK | 133 |
| gi\|18091781 | VVGYHSDRCT | SRFGRRRPFI | VAGAGL-VTVA | VFLI GYAADI | GHSMGDQLDK | 128 |
| gi\|415988 | VVGYESDNCT | SRFGRRRPFI | AAGAGL-VCVA | VVLI GFAADL | GHACGDSLGD | 130 |
| gi\|6120115 | IVGYYSDNCT | LRFGRRRPFI | AACACL-VAVA | VFLI GFAADI | GYAAGDTLGK | 124 |
| gi\|17447420 | IVGYYSDNCT | SRFGRRRPFI | AAGAVL-VAVA | VFLI GFAADI | GHMGGDSLGK | 129 |
| gi\|68161544 | VVGYHSDRCT | SRFGRRRPFI | AAGAVL-VAI A | VFLI GYAADI | GRVSGDPLHN | 128 |
| gi\|51863031 | VGYHSDRCT | SRFGRRRPFI | AVGACF-VAMA | VFLI GYAADI | GHL_CGDHVDK | 122 |
| gi\|33620334 | VGYHSDRCT | SRFGRRRPFI | AAGSF-AVAI A | VFLI GYAADL | GHSFGDNLDK | 138 |
| gi\|5230818 | VGYHSDRCT | SRFGRRRPFI | AAGSI-AVAI A | VFLI GYAADL | GHSFGDSLDQ | 139 |
| gi\|1935019 | VGYHSDRCT | SRFGRRRPFI | AAGAASVAVA | VFLI GYAADL | GHWSGDSI GK | 138 |
| gi\|7649151 | VGYHSDRCT | SRFGRRRPFI | AAGAAFVAI A | VFLI GYAADI | GHLSGDSLDQ | 133 |
| gi\|468562 | VGYHSDRCT | SRFGRRRPFI | ASGAAF-VAI A | VFLI GYAADL | GHLSGDSI GK | 139 |
| CeresGdna:1479767 | VVGYHSDRCT | SRFGRRRPFI | AAGAF-VTI A | VFLI GYAADI | GHLSGDSLIT K | 100 |
| Consensus | IVGYHSDRCT | SRFGRRRPFI | AAGA-LVAI A | VFLI GYAADL | GHASGDSL-K | 150 |

| | | | | | | |
|---|---|---|---|---|---|---|
| gi\|21319 | VAKPRAI AVF | VVGFWI LDVA | NNT_LQGPCRA | LLADMAAGSQ | TKTRY-ANAFF | 189 |
| gi\|5823000 | VPKPRAI AVF | VVGFWI LDVA | NNT_LQGPCRA | LLADMAAGSQ | AKTR-ANAFF | 190 |
| gi\|439294 | GFKPRAI AVF | VVGFWI LDVA | NNMLQGPCRA | LLADLSGGKS | GRMRT SNAFF | 184 |
| gi\|575351 | GSKPRAI AVF | VVGFWI LDVA | NNMLQGPCRA | LLADLSCGKA | -RMRT SNAFF | 177 |
| Lead-CeresClone7894 | PPKTRAI AI F | ALGFWI LDVA | NNT_LQGPCRA | FLADLSAGNA | KKKRT ANAFF | 183 |
| gi\|18091781 | PPRTRAI AI F | ALGFWI LDVA | NNT_LQGPCRA | FLADLSAGNA | KKKRT ANAFF | 178 |
| gi\|415988 | GLKPRAI GVF | VEGFWI LDVA | NNMLQGPCRA | LLADLSGGNT | KKMANANSFF | 180 |
| gi\|6120115 | GTKPRATAVF | VVGFWI LDVA | NNMLQGPCRA | LLADLSGGNA | RKMSN-ANALY | 179 |
| gi\|17447420 | GTKPRAVAVF | VVGFWI LDVA | NNMLQGPCRA | LLADMSAGNA | KKMSS ANSMF | 174 |
| gi\|68161544 | TI KTRAVAVF | VVGFWI LDVS | NNMLQGPCRA | LLADLSGTSA | RRTRT ANALY | 178 |
| gi\|51863031 | PTRPRAI AFF | VVGFWVLDVS | NNMLQGPCRA | LLADLSGNDQ | KKMRT SNALF | 172 |
| gi\|33620334 | KVRPRAI GI F | VVGFWI LDVA | NNMLQGPCRA | LLGDLCAGNH | QKTRN-ANAFF | 188 |
| gi\|5230818 | KVRPRAI GI F | VVGFWI LDVA | NNMLQGPCRA | LLGDLCAGNQ | RKTRN-ANAFF | 189 |
| gi\|1935019 | KVRPRAI GI F | VVGFWI LDVA | NNMLQGPCRA | LLGDLCAGNQ | KKTR-ANAFF | 188 |
| gi\|7649151 | SPKI RAI AI F | VVGFWI LDVA | NNMLQGPCRA | LLADLSGT SQ | KKTRL-ANACF | 183 |
| gi\|468562 | SPKTRAI AI F | VVGFWI LDVA | NNMLQGPCRA | LLADLSGT SQ | KKTR-ANALF | 189 |
| CeresGdna:1479767 | TAKPRAI AVF | VVGFWI LDVA | NNMLQGPCRA | LLADLSGT NQ | KKTRT SNAFF | 150 |
| Consensus | --KPRAI AVF | VVGFWI LDVA | NNMLQGPCRA | LLADLSGGN- | KKTR-ANAFF | 200 |

MODULATING PLANT OIL LEVELS

CROSS-REFERENCE TO RELATED APPLICATIONS

This Application is a National Stage application under 35 U.S.C. §371 of International Application No. PCT/US2007/002214, having an International Filing Date of Jan. 26, 2007, which claims priority under 35 U.S.C. 119(e) to U.S. Provisional Application No. 60/762,422, filed Jan. 26, 2006, and U.S. Provisional Application No. 60/797,077, filed May 1, 2006, all of which are incorporated herein by reference in their entirety.

BACKGROUND

1. Technical Field

This document relates to methods and materials involved in modulating (e.g., increasing or decreasing) oil levels in plants. For example, this document provides plants having increased oil levels as well as materials and methods for making plants and plant products having increased oil levels.

2. Incorporation-by-Reference & Texts

The material on the accompanying diskette is hereby incorporated by reference into this application. The accompanying compact discs contain one identical file, 11696-204WO1-Sequence.txt, which was created on Jan. 26, 2007. The file named 11696-204WO1-Sequence.txt is 1128 KB. The file can be accessed using Microsoft Word on a computer that uses Windows OS.

3. Background Information

Fat, protein, and carbohydrates are nutrients that supply calories to the body. Fat provides nine calories per gram, which is more than twice the number provided by carbohydrates or protein. Dietary fats are composed of fatty acids and glycerol. The glycerol can be converted to glucose by the liver and used as a source of energy. The fatty acids are a good source of energy for many tissues, especially heart and skeletal muscle.

Fatty acids consist of carbon chains of various lengths and a terminal carboxylic acid group. Saturated fatty acids do not contain any double bonds or other functional groups along the chain. A saturated fatty acid has the maximum possible number of hydrogen atoms attached to every carbon atom. Therefore, it is said to be saturated with hydrogen atoms. Eating too much saturated fat is one of the major risk factors for heart disease. Saturated fats are found in animal products such as butter, cheese, whole milk, ice cream, cream, and fatty meats. Saturated fats are also found in some vegetable oils, such as coconut, palm, and palm kernel oils. Most other vegetable oils contain unsaturated fat that helps to lower blood cholesterol if used in place of saturated fat.

Unsaturated fatty acids contain one or more double bonds between carbon atoms and, therefore, two fewer hydrogen atoms per double bond. A fatty acid with a single double bond is called a monounsaturated fatty acid. A fatty acid with two or more double bonds is called a polyunsaturated fatty acid. Polyunsaturated fats are liquid at room temperature, and remain in liquid form even when refrigerated or frozen. Polyunsaturated fats are divided into two families: the omega-3 fats and the omega-6 fats.

The omega-3 family of fatty acids includes alpha-linolenic acid (ALA). ALA is an essential fatty acid that cannot be synthesized in the body and must, therefore, be consumed in the diet. Dietary sources of ALA include canola, flaxseed, flaxseed oil, soybean, and pumpkin seed oil. Omega-3 fatty acids have been found to reduce the risks of heart problems, lower high blood pressure, and ameliorate autoimmune diseases.

Omega-6 fatty acids are beneficial as well. The omega-6 family of fatty acids includes linoleic acid, which is another essential fatty acid. The body converts linoleic acid to gamma linoleic acid (GLA) and ultimately to prostaglandins, which are hormone-like molecules that help regulate inflammation and blood pressure as well as heart, gastrointestinal, and kidney functions. The main sources of omega-6 fatty acids are vegetable oils such as corn oil and soy oil.

Vegetable oil is fat extracted from plant sources. Vegetable oils are used in cooking, in making margarine and other processed foods, and in producing several non-food items such as soap, cosmetics, medicine, and paint. Since vegetable oils are usually extracted from the seeds of the plant, seed oil yield has a significant impact on the economics of producing many products. Increasing seed oil content may increase the economic return per unit to the seller of the seed in addition to increasing the nutritional value to the consumer of the seed.

SUMMARY

This document provides methods and materials related to plants having modulated (e.g., increased or decreased) levels of oil. For example, this document provides transgenic plants and plant cells having increased levels of oil, nucleic acids used to generate transgenic plants and plant cells having increased levels of oil, and methods for making plants and plant cells having increased levels of oil. Such plants and plant cells can be grown to produce, for example, seeds having increased oil content. Increasing the oil content of seeds can increase the nutritional value of the seeds and the yield of oil obtained from the seeds, which may benefit both food consumers and producers.

In one aspect, a method of modulating the level of oil in a plant is provided. The method comprises introducing into a plant cell an isolated nucleic acid comprising a nucleotide sequence encoding a polypeptide having 80 percent or greater sequence identity to an amino acid sequence selected from the group consisting of SEQ ID NOs:81-92, SEQ ID NO:94, SEQ ID NOs:96-107, SEQ ED NO:109, SEQ ID NOs:111-116, SEQ ID NOs:118-134, SEQ ID NOs:136-140, SEQ ID NO:142, SEQ ID NO:144, SEQ ID NOs:146-147, SEQ ID NOs:149-150, SEQ ID NO:152, SEQ ID NO:154, SEQ ID NOs:156-157, SEQ ID NOs:159-169, SEQ ID NOs:171-172, SEQ ID NO:174, SEQ ID NO:176, SEQ ID NOs:178-179, SEQ ID NOs:181-182, SEQ ID NOs:184-191, SEQ ID NOs:193-196, SEQ ID NOs:198-217, SEQ ID NOs:219-220, SEQ ID NOs:222-229, SEQ ID NOs:231-238, SEQ ID NO:240, SEQ ID NOs:242-250, SEQ ID NOs:252-330, SEQ ID NOs:332-333, SEQ ID NO:335, SEQ ID NOs:337-340, SEQ ID NO:342, SEQ ID NO:344, SEQ ID NOs:346-348, SEQ ID NOs:350-357, SEQ ID NOs:359-366, SEQ ID NO:368, SEQ ID NOs:370-372, SEQ ID NOs:374-376, SEQ ID NOs:378-379, SEQ ID NOs:381-396, SEQ ID NO:398, SEQ ID NOs:502-545, and the consensus sequences set forth in FIGS. 1-13, where a tissue of a plant produced from the plant cell has a difference in the level of oil as compared to the corresponding level in tissue of a control plant that does not comprise the nucleic acid.

In another aspect, a method of modulating the level of oil in a plant is provided. The method comprises introducing into a plant cell an isolated nucleic acid comprising a nucleotide sequence encoding a polypeptide having 80 percent or greater sequence identity to an amino acid sequence selected from the group consisting of SEQ ID NOs:81-82, SEQ ID NOs:

84-85, SEQ ID NO:87, SEQ ID NO:91, SEQ ID NO:94, SEQ ID NOs:96-101, SEQ ID NOs:103-105, SEQ ID NO:109, SEQ ID NO:111, SEQ ID NOs:113-115, SEQ ID NO:118, SEQ ID NOs:120-121, SEQ ID NOs:125-132, SEQ ID NO:134, SEQ ID NO:136, SEQ ID NOs:139-140, SEQ ID NO:142, SEQ ID NO:144, SEQ ID NOs:146-147, SEQ ID NO:149, SEQ ID NO:152, SEQ ID NO:154, SEQ ID NOs:156-157, SEQ ID NO:159, SEQ ID NOs:162-168, SEQ ID NOs:171-172, SEQ ID NO:174, SEQ ID NO:176, SEQ ID NO:178, SEQ ID NO:181, SEQ ID NO:184, SEQ ID NOs:193-194, SEQ ID NO:198, SEQ ID NO:207, SEQ ID NOs:215-217, SEQ ID NOs:219-220, SEQ ID NOs:222-223, SEQ ID NOs:231-232, SEQ ID NO:235, SEQ ID NO:238, SEQ ID NO:240, SEQ ID NO:242, SEQ ID NOs:244-246, SEQ ID NO:250, SEQ ID NO:252, SEQ ID NO:254, SEQ ID NOs:257-258, SEQ ID NO:261, SEQ ID NOs:265-267, SEQ ID NO:270, SEQ ID NO:279, SEQ ID NOs:287-293, SEQ ID NOs:300-301, SEQ ID NO:304, SEQ ID NOs:307-309, SEQ ID NOs:311-313, SEQ ID NOs:317-318, SEQ ID NO:320, SEQ ID NOs:323-324, SEQ ID NO:327, SEQ ID NO:332, SEQ ID NO:335, SEQ ID NOs:337-340, SEQ ID NO:342, SEQ ID NO:344, SEQ ID NOs:346-348, SEQ ID NOs:350-351, SEQ ID NOs:355-357, SEQ ID NOs:359-361, SEQ ID NOs:363-366, SEQ ID NO:368, SEQ ID NOs:370-372, SEQ ID NO:374, SEQ ID NO:378, SEQ ID NO:381, SEQ ID NO:398, SEQ ID NOs:502-505, SEQ ID NOs:507-519, SEQ ID NO:521, SEQ ID NOs:524-527, SEQ ID NOs:529-534, SEQ ID NO:541, SEQ ID NOs:544-545, and the consensus sequences set forth in FIGS. 1-13, where a tissue of a plant produced from the plant cell has a difference in the level of oil as compared to the corresponding level in tissue of a control plant that does not comprise the nucleic acid.

In another aspect, a method of modulating the level of oil in a plant is provided. The method comprises introducing into a plant cell an isolated nucleic acid comprising a nucleotide sequence encoding a polypeptide having 80 percent or greater sequence identity to an amino acid sequence selected from the group consisting of SEQ ID NOs:81-82, SEQ ID NOs:84-85, SEQ ID NO:87, SEQ ID NO:91, SEQ ID NO:94, SEQ ID NOs:96-101, SEQ ID NOs:103-105, SEQ ID NO:109, SEQ ID NO:111, SEQ ID NOs:113-115, SEQ ID NO:118, SEQ ID NOs:120-121, SEQ ID NOs:125-132, SEQ ID NO:134, SEQ ID NO:136, SEQ ID NOs:139-140, SEQ ID NO:142, SEQ ID NO:144, SEQ ID NOs:146-147, SEQ ID NO:149, SEQ ID NO:152, SEQ ID NO:154, SEQ ID NOs:156-157, SEQ ID NO:159, SEQ ID NOs:162-168, SEQ ID NOs:171-172, SEQ ID NO:174, SEQ ID NO:176, SEQ ID NO:178, SEQ ID NO:181, SEQ ID NO:184, SEQ ID NOs:193-194, SEQ ID NO:198, SEQ ID NO:207, SEQ ID NOs:215-217, SEQ ID NOs:219-220, SEQ ID NOs:222-223, SEQ ID NOs:231-232, SEQ ID NO:235, SEQ ID NO:238, SEQ ID NO:240, SEQ ID NO:242, SEQ ID NOs:244-246, SEQ ID NO:250, SEQ ID NO:252, SEQ ID NO:254, SEQ ID NOs:257-258, SEQ ID NO:261, SEQ ID NOs:265-267, SEQ ID NO:270, SEQ ID NO:279, SEQ ID NOs:287-293, SEQ ID NOs:300-301, SEQ ID NO:304, SEQ ID NOs:307-309, SEQ ID NOs:311-313, SEQ ID NOs:317-318, SEQ ID NO:320, SEQ ID NOs:323-324, SEQ ID NO:327, SEQ ID NO:332, SEQ ID NO:335, SEQ ID NOs:337-340, SEQ ID NO:342, SEQ ID NO:344, SEQ ID NOs:346-348, SEQ ID NOs:350-351, SEQ ID NOs:355-357, SEQ ID NOs:359-361, SEQ ID NOs:363-366, SEQ ID NO:368, SEQ ID NOs:370-372, SEQ ID NO:374, SEQ ID NO:378, SEQ ID NO:381, SEQ ID NO:398, SEQ ID NOs:502-505, SEQ ID NOs:507-519, SEQ ID NO:521, SEQ ID NOs:524-527, SEQ ID NOs:529-534, SEQ ID NO:541, and SEQ ID NOs:544-545, where a tissue of a plant produced from the plant cell has a difference in the level of oil as compared to the corresponding level in tissue of a control plant that does not comprise the nucleic acid.

The sequence identity can be 85 percent or greater, 90 percent or greater, or 95 percent or greater. The nucleotide sequence can encode a polypeptide comprising an amino acid sequence corresponding to SEQ ID NO:81. The nucleotide sequence can encode a polypeptide comprising an amino acid sequence corresponding to SEQ ID NO:94. The nucleotide sequence can encode a polypeptide comprising an amino acid sequence corresponding to SEQ ID NO:111. The nucleotide sequence can encode a polypeptide comprising an amino acid sequence corresponding to SEQ ID NO:136. The nucleotide sequence can encode a polypeptide comprising an amino acid sequence corresponding to SEQ ID NO:152. The nucleotide sequence can encode a polypeptide comprising an amino acid sequence corresponding to SEQ ID NO:159. The nucleotide sequence can encode a polypeptide comprising an amino acid sequence corresponding to SEQ ID NO:171. The nucleotide sequence can encode a polypeptide comprising an amino acid sequence corresponding to SEQ ID NO:176. The nucleotide sequence can encode a polypeptide comprising an amino acid sequence corresponding to SEQ ID NO:178. The nucleotide sequence can encode a polypeptide comprising an amino acid sequence corresponding to SEQ ID NO:193. The nucleotide sequence can encode a polypeptide comprising an amino acid sequence corresponding to SEQ ID NO:332. The nucleotide sequence can encode a polypeptide comprising an amino acid sequence corresponding to SEQ ID NO:342. The nucleotide sequence can encode a polypeptide comprising an amino acid sequence corresponding to SEQ ID NO:344. The nucleotide sequence can encode a polypeptide comprising an amino acid sequence corresponding to SEQ ID NO:346. The nucleotide sequence can encode a polypeptide comprising an amino acid sequence corresponding to SEQ ID NO:359. The nucleotide sequence can encode a polypeptide comprising an amino acid sequence corresponding to SEQ ID NO:374. The nucleotide sequence can encode a polypeptide comprising an amino acid sequence corresponding to SEQ ID NO:398. The nucleotide sequence can encode a polypeptide comprising an amino acid sequence corresponding to a consensus sequence set forth in FIG. 1, FIG. 2, FIG. 3, FIG. 4, FIG. 5, FIG. 6, FIG. 7, FIG. 8, FIG. 9, FIG. 10, FIG. 11, FIG. 12, or FIG. 13. The difference can be an increase in the level of oil. The isolated nucleic acid can be operably linked to a regulatory region. The regulatory region can be a tissue-preferential regulatory region tissue-preferential regulatory region can be a promoter. The regulatory region can be a broadly expressing promoter. The plant can be a dicot. The plant can be a member of the genus *Anacardium, Arachis, Azadirachta, Brassica, Cannabis, Carthamus, Corylus, Crambe, Cucurbita, Glycine, Gossypium, Helianthus, Jatropha, Juglans, Linum, Olea, Papaver, Persea, Prunus, Ricinus, Sesamum, Simmondsia*, or *Vitis*. The plant can be a monocot. The plant can be a member of the genus *Cocos, Elaeis, Oryza*, or *Zea*. The tissue can be seed tissue.

A method of producing a plant tissue is also provided. The method comprises growing a plant cell comprising an exogenous nucleic acid comprising a nucleotide sequence encoding a polypeptide having 80 percent or greater sequence identity to an amino acid sequence selected from the group consisting of SEQ ID NOs:81-92, SEQ ID NO:94, SEQ ID NOs:96-107, SEQ ID NO:109, SEQ ID NOs:111-116, SEQ ID NOs:118-134, SEQ ID NOs:136-140, SEQ ID NO:142, SEQ ID NO:144, SEQ ID NOs:146-147, SEQ ID NOs:149-150, SEQ ID NO:152, SEQ ID NO:154, SEQ ID NOs:156-157, SEQ ID NOs:159-169, SEQ ID NOs:171-172, SEQ ID NO:174, SEQ ID NO:176, SEQ ID NOs:178-179, SEQ ID NOs:181-182, SEQ ID NOs:184-191, SEQ ID NOs:193-196, SEQ ID NOs:198-217, SEQ ID NOs:219-220, SEQ ID NOs:222-229, SEQ ID NOs:231-238, SEQ ID NO:240, SEQ ID NOs:242-250, SEQ ID NOs:252-330, SEQ ID NOs:332-333, SEQ ID NO:335, SEQ ID NOs:337-340, SEQ ID NO:342, SEQ ID NO:344, SEQ ID NO:346-348, SEQ ID NOs:350-357, SEQ ID NOs:359-366, SEQ ID NO:368, SEQ ID NOs:370-372, SEQ ID NOs:374-376, SEQ ID NOs:378-379, SEQ ID NOs:381-396, SEQ ID NO:398, SEQ ID NOs:502-545, and the consensus sequences set forth in FIGS. 1-13, where the tissue has a difference in the level of oil as compared to the corresponding level in tissue of a control plant that does not comprise the nucleic acid.

In another aspect, a method of producing a plant tissue is provided. The method comprises growing a plant cell comprising an exogenous nucleic acid comprising a nucleotide sequence encoding a polypeptide having 80 percent or greater sequence identity to an amino acid sequence selected from the group consisting of SEQ ID NOs:81-82, SEQ ID NOs:84-85, SEQ ID NO:87, SEQ ID NO:91, SEQ ID NO:94, SEQ ID NOs:96-101, SEQ ID NOs:103-105, SEQ ID NO:109, SEQ ID NO:111, SEQ ID NOs:113-115, SEQ ID NO:118, SEQ ID NOs:120-121, SEQ ID NOs:125-132, SEQ ID NO:134, SEQ ID NO:136, SEQ ID NOs:139-140, SEQ ID NO:142, SEQ ID NO:144, SEQ ID NOs:146-147, SEQ ID NO:149, SEQ ID NO:152, SEQ ID NO:154, SEQ ID NOs:156-157, SEQ ID NO:159, SEQ ID NOs:162-168, SEQ ID NOs:171-172, SEQ ID NO:174, SEQ ID NO:176, SEQ ID NO:178, SEQ ID NO:181, SEQ ID NO:184, SEQ ID NOs:193-194, SEQ ID NO:198, SEQ ID NO:207, SEQ ID NOs:215-217, SEQ ID NOs:219-220, SEQ ID NOs:222-223, SEQ ID NOs:231-232, SEQ ID NO:235, SEQ ID NO:238, SEQ ID NO:240, SEQ ID NO:242, SEQ ID NOs:244-246, SEQ ID NO:250, SEQ ID NO:252, SEQ ID NO:254, SEQ ID NOs:257-258, SEQ ID NO:261, SEQ ID NOs:265-267, SEQ ID NO:270, SEQ ID NO:279, SEQ ID NOs:287-293, SEQ ID NOs:300-301, SEQ ID NO:304, SEQ ID NOs:307-309, SEQ ID NOs:311-313, SEQ ID NOs:317-318, SEQ ID NO:320, SEQ ID NOs:323-324, SEQ ID NO:327, SEQ ID NO:332, SEQ ID NO:335, SEQ ID NOs:337-340, SEQ ID NO:342, SEQ ID NO:344, SEQ ID NOs:346-348, SEQ ID NOs:350-351, SEQ ID NOs:355-357, SEQ ID NOs:359-361, SEQ ID NOs:363-366, SEQ ID NO:368, SEQ ID NOs:370-372, SEQ ID NO:374, SEQ ID NO:378, SEQ ID NO:381, SEQ ID NO:398, SEQ ID NOs:502-505, SEQ ID NOs:507-519, SEQ ID NO:521, SEQ ID NOs:524-527, SEQ ID NOs:529-534, SEQ ID NO:541, SEQ ID NOs:544-545, and the consensus sequences set forth in FIGS. 1-13, where the tissue has a difference in the level of oil as compared to the corresponding level in tissue of a control plant that does not comprise the nucleic acid.

In another aspect, a method of producing a plant tissue is provided. The method comprises growing a plant cell comprising an exogenous nucleic acid comprising a nucleotide sequence encoding a polypeptide having 80 percent or greater sequence identity to an amino acid sequence selected from the group consisting of SEQ ID NOs:81-82, SEQ ID NOs:84-85, SEQ ID NO:87, SEQ ID NO:91, SEQ ID NO:94, SEQ ID NOs:96-101, SEQ ID NOs:103-105, SEQ ID NO:109, SEQ ID NO:111, SEQ ID NOs:113-115, SEQ ID NO:118, SEQ ID NOs:120-121, SEQ ID NOs:125-132, SEQ ID NO:134, SEQ ID NO:136, SEQ ID NOs:139-140, SEQ ID NO:142, SEQ ID NO:144, SEQ ID NOs:146-147, SEQ ID NO:149, SEQ ID NO:152, SEQ ID NO:154, SEQ ID NOs:156-157, SEQ ID NO:159, SEQ ID NOs:162-168, SEQ ID NOs:171-172, SEQ ID NO:174, SEQ ID NO:176, SEQ ID NO:178, SEQ ID NO:181, SEQ ID NO:184, SEQ ID NOs:193-194, SEQ ID NO:198, SEQ ID NO:207, SEQ ID NOs:215-217, SEQ ID NOs:219-220, SEQ ID NOs:222-223, SEQ ID NOs:231-232, SEQ ID NO:235, SEQ ID NO:238, SEQ ID NO:240, SEQ ID NO:242, SEQ ID NOs:244-246, SEQ ID NO:250, SEQ ID NO:252, SEQ ID NO:254, SEQ ID NOs:257-258, SEQ ID NO:261, SEQ ID NOs:265-267, SEQ ID NO:270, SEQ ID NO:279, SEQ ID NOs:287-293, SEQ ID NOs:300-301, SEQ ID NO:304, SEQ ID NOs:307-309, SEQ ID NOs:311-313, SEQ ID NOs:317-318, SEQ ID NO:320, SEQ ID NOs:323-324, SEQ ID NO:327, SEQ ID NO:332, SEQ ID NO:335, SEQ ID NOs:337-340, SEQ ID NO:342, SEQ ID NO:344, SEQ ID NOs:346-348, SEQ ID NOs:350-351, SEQ ID NOs:355-357, SEQ ID NOs:359-361, SEQ ID NOs:363-366, SEQ ID NO:368, SEQ ID NOs:370-372, SEQ ID NO:374, SEQ ID NO:378, SEQ ID NO:381, SEQ ID NO:398, SEQ ID NOs:502-505, SEQ ID NOs:507-519, SEQ ID NO:521, SEQ ID NOs:524-527, SEQ ID NOs:529-534, SEQ ID NO:541, and SEQ ID NOs:544-545, where the tissue has a difference in the level of oil as compared to the corresponding level in tissue of a control plant that does not comprise the nucleic acid.

The sequence identity can be 85 percent or greater, 90 percent or greater, or 95 percent or greater. The nucleotide sequence can encode a polypeptide comprising an amino acid sequence corresponding to SEQ ID NO:81. The nucleotide sequence can encode a polypeptide comprising an amino acid sequence corresponding to SEQ ID NO:94. The nucleotide sequence can encode a polypeptide comprising an amino acid sequence corresponding to SEQ ID NO:111. The nucleotide sequence can encode a polypeptide comprising an amino acid sequence corresponding to SEQ ID NO:136. The nucleotide sequence can encode a polypeptide comprising an amino acid sequence corresponding to SEQ ID NO:152. The nucleotide sequence can encode a polypeptide comprising an amino acid sequence corresponding to SEQ ID NO:159. The nucleotide sequence can encode a polypeptide comprising an amino acid sequence corresponding to SEQ ID NO:171. The nucleotide sequence can encode a polypeptide comprising an amino acid sequence corresponding to SEQ ID NO:176. The nucleotide sequence can encode a polypeptide comprising an amino acid sequence corresponding to SEQ ID NO:178. The nucleotide sequence can encode a polypeptide comprising an amino acid sequence corresponding to SEQ ID NO:193. The nucleotide sequence can encode a polypeptide comprising an amino acid sequence corresponding to SEQ ID NO:332. The nucleotide sequence can encode a polypeptide comprising an amino acid sequence corresponding to SEQ ID NO:342. The nucleotide sequence can encode a polypeptide comprising an amino acid sequence corresponding to SEQ ID NO:344. The nucleotide sequence can encode a polypeptide comprising an amino acid sequence corresponding to SEQ ID NO:346. The nucleotide sequence can encode a polypeptide comprising an amino acid sequence corresponding to SEQ ID NO:359. The nucleotide sequence can encode a polypeptide comprising an amino acid sequence corresponding to SEQ ID NO:374. The nucleotide sequence can encode a polypeptide comprising an amino acid sequence corresponding to SEQ ID NO:398. The difference can be an increase in the level of oil. The exogenous nucleic acid can be operably linked to a regulatory region. The regulatory region can be a tissue-preferential regulatory region. The tissue-preferential regulatory region can be a promoter. The regulatory region can be a broadly expressing promoter. The plant tissue can be dicotyledonous. The plant tissue can be a member of the genus *Anacardium, Arachis, Azadirachta, Brassica, Cannabis, Carthamus, Corylus, Crambe, Cucurbita, Glycine, Gossypium, Helianthus, Jatropha, Juglans, Linum, Olea, Papaver, Persea, Prunus, Ricinus, Sesamum,*

*Simmondsia*, or *Vitis*. The plant tissue can be monocotyledonous. The plant tissue can be a member of the genus *Cocos*, *Elaeis*, *Oryza*, or *Zea*. The tissue can be seed tissue.

A plant cell is also provided. The plant cell comprises an exogenous nucleic acid comprising a nucleotide sequence encoding a polypeptide having 80 percent or greater sequence identity to an amino acid sequence selected from the group consisting of SEQ ID NOs:81-92, SEQ ID NO:94, SEQ ID NOs:96-107, SEQ ID NO:109, SEQ ID NOs:111-116, SEQ ID NOs:118-134, SEQ ID NOs:136-140, SEQ ID NO:142, SEQ ID NO:144, SEQ ID NOs:146-147, SEQ ID NOs:149-150, SEQ ID NO:152, SEQ ID NO:154, SEQ ID NOs:156-157, SEQ ID NOs:159-169, SEQ ID NOs:171-172, SEQ ID NO:174, SEQ ID NO:176, SEQ ID NOs:178-179, SEQ ID NOs:181-182, SEQ ID NOs:184-191, SEQ ID NOs:193-196, SEQ ID NOs:198-217, SEQ ID NOs:219-220, SEQ ID NOs:222-229, SEQ ID NOs:231-238, SEQ ID NO:240, SEQ ID NOs:242-250, SEQ ID NOs:252-330, SEQ ID NOs:332-333, SEQ ID NO:335, SEQ ID NOs:337-340, SEQ ID NO:342, SEQ ID NO:344, SEQ ID NO:346-348, SEQ ID NOs:350-357, SEQ ID NOs:359-366, SEQ ID NO:368, SEQ ID NOs:370-372, SEQ ID NOs:374-376, SEQ ID NOs:378-379, SEQ ID NOs:381-396, SEQ ID NO:398, SEQ ID NOs:502-545, and the consensus sequences set forth in FIGS. 1-13, where a tissue of a plant produced from the plant cell has a difference in the level of oil as compared to the corresponding level in tissue of a control plant that does not comprise the nucleic acid.

In another aspect, a plant cell is provided. The plant cell comprises an exogenous nucleic acid comprising a nucleotide sequence encoding a polypeptide having 80 percent or greater sequence identity to an amino acid sequence selected from the group consisting of SEQ ID NOs:81-82, SEQ ID NOs:84-85, SEQ ID NO:87, SEQ ID NO:91, SEQ ID NO:94, SEQ ID NOs:96-101, SEQ ID NOs:103-105, SEQ ID NO:109, SEQ ID NO:111, SEQ ID NOs:113-115, SEQ ID NO:118, SEQ ID NOs:120-121, SEQ ID NOs:125-132, SEQ ID NO:134, SEQ ID NO:136, SEQ ID NOs:139-140, SEQ ID NO:142, SEQ ID NO:144, SEQ ID NOs:146-147, SEQ ID NO:149, SEQ ID NO:152, SEQ ID NO:154, SEQ ID NOs:156-157, SEQ ID NO:159, SEQ ID NOs:162-168, SEQ ID NOs:171-172, SEQ ID NO:174, SEQ ID NO:176, SEQ ID NO:178, SEQ ID NO:181, SEQ ID NO:184, SEQ ID NOs:193-194, SEQ ID NO:198, SEQ ID NO:207, SEQ ID NOs:215-217, SEQ ID NOs:219-220, SEQ ID NOs:222-223, SEQ ID NOs:231-232, SEQ ID NO:235, SEQ ID NO:238, SEQ ID NO:240, SEQ ID NO:242, SEQ ID NOs:244-246, SEQ ID NO:250, SEQ ID NO:252, SEQ ID NO:254, SEQ ID NOs:257-258, SEQ ID NO:261, SEQ ID NOs:265-267, SEQ ID NO:270, SEQ ID NO:279, SEQ ID NOs:287-293, SEQ ID NOs:300-301, SEQ ID NO:304, SEQ ID NOs:307-309, SEQ ID NOs:311-313, SEQ ID NOs:317-318, SEQ ID NO:320, SEQ ID NOs:323-324, SEQ ID NO:327, SEQ ID NO:332, SEQ ID NO:335, SEQ ID NOs:337-340, SEQ ID NO:342, SEQ ID NO:344, SEQ ID NOs:346-348, SEQ ID NOs:350-351, SEQ ID NOs:355-357, SEQ ID NOs:359-361, SEQ ID NOs:363-366, SEQ ID NO:368, SEQ ID NOs:370-372, SEQ ID NO:374, SEQ ID NO:378, SEQ ID NO:381, SEQ ID NO:398, SEQ ID NOs:502-505, SEQ ID NOs:507-519, SEQ ID NO:521, SEQ ID NOs:524-527, SEQ ID NOs:529-534, SEQ ID NO:541, and SEQ ID NOs:544-545, where a tissue of a plant produced from the plant cell has a difference in the level of oil as compared to the corresponding level in tissue of a control plant that does not comprise the nucleic acid.

The sequence identity can be 85 percent or greater, 90 percent or greater, or 95 percent or greater. The nucleotide sequence can encode a polypeptide comprising an amino acid sequence corresponding to SEQ ID NO:81. The nucleotide sequence can encode a polypeptide comprising an amino acid sequence corresponding to SEQ ID NO:94. The nucleotide sequence can encode a polypeptide comprising an amino acid sequence corresponding to SEQ ID NO:111. The nucleotide sequence can encode a polypeptide comprising an amino acid sequence corresponding to SEQ ID NO:136. The nucleotide sequence can encode a polypeptide comprising an amino acid sequence corresponding to SEQ ID NO:152. The nucleotide sequence can encode a polypeptide comprising an amino acid sequence corresponding to SEQ ID NO:159. The nucleotide sequence can encode a polypeptide comprising an amino acid sequence corresponding to SEQ ID NO:171. The nucleotide sequence can encode a polypeptide comprising an amino acid sequence corresponding to SEQ ID NO:176. The nucleotide sequence can encode a polypeptide comprising an amino acid sequence corresponding to SEQ ID NO:178 The nucleotide sequence can encode a polypeptide comprising an amino acid sequence corresponding to SEQ ID NO:193. The nucleotide sequence can encode a polypeptide comprising an amino acid sequence corresponding to SEQ ID NO:332. The nucleotide sequence can encode a polypeptide comprising an amino acid sequence corresponding to SEQ ID NO:342. The nucleotide sequence can encode a polypeptide comprising an amino acid sequence corresponding to SEQ ID NO:344. The nucleotide sequence can encode a polypeptide comprising an amino acid sequence corresponding to SEQ ID NO:346. The nucleotide sequence can encode a polypeptide comprising an amino acid sequence corresponding to SEQ ID NO:359. The nucleotide sequence can encode a polypeptide comprising an amino acid sequence corresponding to SEQ ID NO:374. The nucleotide sequence can encode a polypeptide comprising an amino acid sequence corresponding to SEQ ID NO:398. The nucleotide sequence can encode a polypeptide comprising an amino acid sequence corresponding to a consensus sequence set forth in FIG. 1, FIG. 2, FIG. 3, FIG. 4, FIG. 5, FIG. 6, FIG. 7, FIG. 8, FIG. 9, FIG. 10, FIG. 11, FIG. 12, or FIG. 13. The difference can be an increase in the level of oil. The exogenous nucleic acid can be operably linked to a regulatory region. The regulatory region can be a tissue-preferential regulatory region. The tissue-preferential regulatory region can be a promoter. The regulatory region can be a broadly expressing promoter. The plant can be a dicot. The plant can be a member of the genus *Anacardium, Arachis, Azadirachta, Brassica, Cannabis, Carthainus, Corylus, Crambe, Cucurbita, Glycine, Gossypium, Helianthus, Jatropha, Juglans, Linum, Olea, Papaver, Persea, Prunus, Ricinus, Sesamum, Simmondsia*, or *Vitis*. The plant can be a monocot. The plant can be a member of the genus *Cocos, Elaeis, Oryza*, or *Zea*. The tissue can be seed tissue.

A transgenic plant is also provided. The transgenic plant comprises any of the plant cells described above. Progeny of the transgenic plant are also provided. The progeny have a difference in the level of oil as compared to the level of oil in corresponding control plants that do not comprise the exogenous nucleic acid. Seed and vegetative tissue from the transgenic plant are also provided. In addition, food products and feed products comprising seed and/or vegetative tissue from the transgenic plant are provided. Oil from the seed of the transgenic plant is provided, as is a method of making oil. The method comprises extracting oil from the seed of the transgenic plant.

In another aspect, an isolated nucleic acid molecule is provided. The isolated nucleic acid molecule comprises a nucleotide sequence having 95% or greater sequence identity to the nucleotide sequence set forth in SEQ ID NO:95.

In another aspect, an isolated nucleic acid is provided. The isolated nucleic acid comprises a nucleotide sequence encoding a polypeptide having 80% or greater sequence identity to the amino acid sequence set forth in SEQ ID NO:96.

In another aspect, an isolated nucleic acid molecule is provided. The isolated nucleic acid molecule comprises a nucleotide sequence having 95% or greater sequence identity to the nucleotide sequence set forth in SEQ ID NO:108.

In another aspect, an isolated nucleic acid is provided. The isolated nucleic acid comprises a nucleotide sequence encoding a polypeptide having 80% or greater sequence identity to the amino acid sequence set forth in SEQ ID NO:109.

In another aspect, an isolated nucleic acid molecule is provided. The isolated nucleic acid molecule comprises a nucleotide sequence having 95% or greater sequence identity to the nucleotide sequence set forth in SEQ ID NO:117.

In another aspect, an isolated nucleic acid is provided. The isolated nucleic acid comprises a nucleotide sequence encoding a polypeptide having 80% or greater sequence identity to the amino acid sequence set forth in SEQ ID NO:118.

In another aspect, an isolated nucleic acid molecule is provided. The isolated nucleic acid molecule comprises a nucleotide sequence having 95% or greater sequence identity to the nucleotide sequence set forth in SEQ ID NO:141.

In another aspect, an isolated nucleic acid is provided. The isolated nucleic acid comprises a nucleotide sequence encoding a polypeptide having 80% or greater sequence identity to the amino acid sequence set forth in SEQ ID NO:142.

In another aspect, an isolated nucleic acid molecule is provided. The isolated nucleic acid molecule comprises a nucleotide sequence having 95% or greater sequence identity to the nucleotide sequence set forth in SEQ ID NO:143.

In another aspect, an isolated nucleic acid is provided. The isolated nucleic acid comprises a nucleotide sequence encoding a polypeptide having 80% or greater sequence identity to the amino acid sequence set forth in SEQ ID NO:144.

In another aspect, an isolated nucleic acid molecule is provided. The isolated nucleic acid molecule comprises a nucleotide sequence having 95% or greater sequence identity to the nucleotide sequence set forth in SEQ ID NO:145.

In another aspect, an isolated nucleic acid is provided. The isolated nucleic acid comprises a nucleotide sequence encoding a polypeptide having 80% or greater sequence identity to the amino acid sequence set forth in SEQ ID NO:146.

In another aspect, an isolated nucleic acid molecule is provided. The isolated nucleic acid molecule comprises a nucleotide sequence having 95% or greater sequence identity to the nucleotide sequence set forth in SEQ ID NO:148.

In another aspect, an isolated nucleic acid is provided. The isolated nucleic acid comprises a nucleotide sequence encoding a polypeptide having 80% or greater sequence identity to the amino acid sequence set forth in SEQ ID NO:149.

In another aspect, an isolated nucleic acid molecule is provided. The isolated nucleic acid molecule comprises a nucleotide sequence having 95% or greater sequence identity to the nucleotide sequence set forth in SEQ ID NO:153.

In another aspect, an isolated nucleic acid is provided. The isolated nucleic acid comprises a nucleotide sequence encoding a polypeptide having 80% or greater sequence identity to the amino acid sequence set forth in SEQ ID NO:154.

In another aspect, an isolated nucleic acid molecule is provided. The isolated nucleic acid molecule comprises a nucleotide sequence having 95% or greater sequence identity to the nucleotide sequence set forth in SEQ ID NO:155.

In another aspect, an isolated nucleic acid is provided. The isolated nucleic acid comprises a nucleotide sequence encoding a polypeptide having 80% or greater sequence identity to the amino acid sequence set forth in SEQ ID NO:156.

In another aspect, an isolated nucleic acid molecule is provided. The isolated nucleic acid molecule comprises a nucleotide sequence having 95% or greater sequence identity to the nucleotide sequence set forth in SEQ ID NO:173.

In another aspect, an isolated nucleic acid is provided. The isolated nucleic acid comprises a nucleotide sequence encoding a polypeptide having 80% or greater sequence identity to the amino acid sequence set forth in SEQ ID NO:174.

In another aspect, an isolated nucleic acid molecule is provided. The isolated nucleic acid molecule comprises a nucleotide sequence having 95% or greater sequence identity to the nucleotide sequence set forth in SEQ ID NO:180.

In another aspect, an isolated nucleic acid is provided. The isolated nucleic acid comprises a nucleotide sequence encoding a polypeptide having 80% or greater sequence identity to the amino acid sequence set forth in SEQ ID NO:181.

In another aspect, an isolated nucleic acid molecule is provided. The isolated nucleic acid molecule comprises a nucleotide sequence having 95% or greater sequence identity to the nucleotide sequence set forth in SEQ ID NO:183.

In another aspect, an isolated nucleic acid is provided. The isolated nucleic acid comprises a nucleotide sequence encoding a polypeptide having 80% or greater sequence identity to the amino acid sequence set forth in SEQ ID NO:184.

In another aspect, an isolated nucleic acid molecule is provided. The isolated nucleic acid molecule comprises a nucleotide sequence having 95% or greater sequence identity to the nucleotide sequence set forth in SEQ ID NO:197.

In another aspect, an isolated nucleic acid is provided. The isolated nucleic acid comprises a nucleotide sequence encoding a polypeptide having 80% or greater sequence identity to the amino acid sequence set forth in SEQ ID NO:198.

In another aspect, an isolated nucleic acid molecule is provided. The isolated nucleic acid molecule comprises a nucleotide sequence having 95% or greater sequence identity to the nucleotide sequence set forth in SEQ ID NO:218.

In another aspect, an isolated nucleic acid is provided. The isolated nucleic acid comprises a nucleotide sequence encoding a polypeptide having 80% or greater sequence identity to the amino acid sequence set forth in SEQ ID NO:219.

In another aspect, an isolated nucleic acid molecule is provided. The isolated nucleic acid molecule comprises a nucleotide sequence having 95% or greater sequence identity to the nucleotide sequence set forth in SEQ ID NO:221.

In another aspect, an isolated nucleic acid is provided. The isolated nucleic acid comprises a nucleotide sequence encoding a polypeptide having 80% or greater sequence identity to the amino acid sequence set forth in SEQ ID NO:222.

In another aspect, an isolated nucleic acid molecule is provided. The isolated nucleic acid molecule comprises a nucleotide sequence having 95% or greater sequence identity to the nucleotide sequence set forth in SEQ ID NO:230.

In another aspect, an isolated nucleic acid is provided. The isolated nucleic acid comprises a nucleotide sequence encoding a polypeptide having 80% or greater sequence identity to the amino acid sequence set forth in SEQ ID NO:231.

In another aspect, an isolated nucleic acid molecule is provided. The isolated nucleic acid molecule comprises a nucleotide sequence having 95% or greater sequence identity to the nucleotide sequence set forth in SEQ ID NO:239.

In another aspect, an isolated nucleic acid is provided. The isolated nucleic acid comprises a nucleotide sequence encoding a polypeptide having 80% or greater sequence identity to the amino acid sequence set forth in SEQ ID NO:240.

In another aspect, an isolated nucleic acid molecule is provided. The isolated nucleic acid molecule comprises a nucleotide sequence having 95% or greater sequence identity to the nucleotide sequence set forth in SEQ ID NO:241.

In another aspect, an isolated nucleic acid is provided. The isolated nucleic acid comprises a nucleotide sequence encoding a polypeptide having 80% or greater sequence identity to the amino acid sequence set forth in SEQ ID NO:242.

In another aspect, an isolated nucleic acid molecule is provided. The isolated nucleic acid molecule comprises a nucleotide sequence having 95% or greater sequence identity to the nucleotide sequence set forth in SEQ ID NO:251.

In another aspect, an isolated nucleic acid is provided. The isolated nucleic acid comprises a nucleotide sequence encoding a polypeptide having 80% or greater sequence identity to the amino acid sequence set forth in SEQ ID NO:252.

In another aspect, an isolated nucleic acid is provided. The isolated nucleic acid comprises a nucleotide sequence encoding a polypeptide having 80% or greater sequence identity to the amino acid sequence set forth in SEQ ID NO:270.

In another aspect, an isolated nucleic acid is provided. The isolated nucleic acid comprises a nucleotide sequence encoding a polypeptide having 80% or greater sequence identity to the amino acid sequence set forth in SEQ ID NO:290.

In another aspect, an isolated nucleic acid is provided. The isolated nucleic acid comprises a nucleotide sequence encoding a polypeptide having 80% or greater sequence identity to the amino acid sequence set forth in SEQ ID NO:292.

In another aspect, an isolated nucleic acid is provided. The isolated nucleic acid comprises a nucleotide sequence encoding a polypeptide having 80% or greater sequence identity to the amino acid sequence set forth in SEQ ID NO:300.

In another aspect, an isolated nucleic acid is provided. The isolated nucleic acid comprises a nucleotide sequence encoding a polypeptide having 80% or greater sequence identity to the amino acid sequence set forth in SEQ ID NO:308.

In another aspect, an isolated nucleic acid is provided. The isolated nucleic acid comprises a nucleotide sequence encoding a polypeptide having 80% or greater sequence identity to the amino acid sequence set forth in SEQ ID NO:309.

In another aspect, an isolated nucleic acid is provided. The isolated nucleic acid comprises a nucleotide sequence encoding a polypeptide having 80% or greater sequence identity to the amino acid sequence set forth in SEQ ID NO:318.

In another aspect, an isolated nucleic acid molecule is provided. The isolated nucleic acid molecule comprises a nucleotide sequence having 95% or greater sequence identity to the nucleotide sequence set forth in SEQ ID NO:334.

In another aspect, an isolated nucleic acid is provided. The isolated nucleic acid comprises a nucleotide sequence encoding a polypeptide having 80% or greater sequence identity to the amino acid sequence set forth in SEQ ID NO:335.

In another aspect, an isolated nucleic acid molecule is provided. The isolated nucleic acid molecule comprises a nucleotide sequence having 95% or greater sequence identity to the nucleotide sequence set forth in SEQ ID NO:336.

In another aspect, an isolated nucleic acid is provided. The isolated nucleic acid comprises a nucleotide sequence encoding a polypeptide having 80% or greater sequence identity to the amino acid sequence set forth in SEQ ID NO:337.

In another aspect, an isolated nucleic acid molecule is provided. The isolated nucleic acid molecule comprises a nucleotide sequence having 95% or greater sequence identity to the nucleotide sequence set forth in SEQ ID NO:349.

In another aspect, an isolated nucleic acid is provided. The isolated nucleic acid comprises a nucleotide sequence encoding a polypeptide having 80% or greater sequence identity to the amino acid sequence set forth in SEQ ID NO:350.

In another aspect, an isolated nucleic acid molecule is provided. The isolated nucleic acid molecule comprises a nucleotide sequence having 95% or greater sequence identity to the nucleotide sequence set forth in SEQ ID NO:367.

In another aspect, an isolated nucleic acid is provided. The isolated nucleic acid comprises a nucleotide sequence encoding a polypeptide having 80% or greater sequence identity to the amino acid sequence set forth in SEQ ID NO:368.

In another aspect, an isolated nucleic acid molecule is provided. The isolated nucleic acid molecule comprises a nucleotide sequence having 95% or greater sequence identity to the nucleotide sequence set forth in SEQ ID NO:369.

In another aspect, an isolated nucleic acid is provided. The isolated nucleic acid comprises a nucleotide sequence encoding a polypeptide having 80% or greater sequence identity to the amino acid sequence set forth in SEQ ID NO:370.

In another aspect, an isolated nucleic acid molecule is provided. The isolated nucleic acid molecule comprises a nucleotide sequence having 95% or greater sequence identity to the nucleotide sequence set forth in SEQ ID NO:377.

In another aspect, an isolated nucleic acid is provided. The isolated nucleic acid comprises a nucleotide sequence encoding a polypeptide having 80% or greater sequence identity to the amino acid sequence set forth in SEQ ID NO:378.

In another aspect, an isolated nucleic acid molecule is provided. The isolated nucleic acid molecule comprises a nucleotide sequence having 95% or greater sequence identity to the nucleotide sequence set forth in SEQ ID NO:380.

In another aspect, an isolated nucleic acid is provided. The isolated nucleic acid comprises a nucleotide sequence encoding a polypeptide having 80% or greater sequence identity to the amino acid sequence set forth in SEQ ID NO:381.

In another aspect, an isolated nucleic acid molecule is provided. The isolated nucleic acid molecule comprises a nucleotide sequence having 95% or greater sequence identity to the nucleotide sequence set forth in SEQ ID NO:474.

In another aspect, an isolated nucleic acid molecule is provided. The isolated nucleic acid molecule comprises a nucleotide sequence having 95% or greater sequence identity to the nucleotide sequence set forth in SEQ ID NO:475.

In another aspect, an isolated nucleic acid molecule is provided. The isolated nucleic acid molecule comprises a nucleotide sequence having 95% or greater sequence identity to the nucleotide sequence set forth in SEQ ID NO:476.

In another aspect, an isolated nucleic acid molecule is provided. The isolated nucleic acid molecule comprises a nucleotide sequence having 95% or greater sequence identity to the nucleotide sequence set forth in SEQ ID NO:477.

In another aspect, an isolated nucleic acid molecule is provided. The isolated nucleic acid molecule comprises a nucleotide sequence having 95% or greater sequence identity to the nucleotide sequence set forth in SEQ ID NO:478.

In another aspect, an isolated nucleic acid molecule is provided. The isolated nucleic acid molecule comprises a nucleotide sequence having 95% or greater sequence identity to the nucleotide sequence set forth in SEQ ID NO:479.

In another aspect, an isolated nucleic acid molecule is provided. The isolated nucleic acid molecule comprises a nucleotide sequence having 95% or greater sequence identity to the nucleotide sequence set forth in SEQ ID NO:480.

In another aspect, an isolated nucleic acid molecule is provided. The isolated nucleic acid molecule comprises a nucleotide sequence having 95% or greater sequence identity to the nucleotide sequence set forth in SEQ ID NO:481.

In another aspect, an isolated nucleic acid molecule is provided. The isolated nucleic acid molecule comprises a nucleotide sequence having 95% or greater sequence identity to the nucleotide sequence set forth in SEQ ID NO:482.

In another aspect, an isolated nucleic acid molecule is provided. The isolated nucleic acid molecule comprises a nucleotide sequence having 95% or greater sequence identity to the nucleotide sequence set forth in SEQ ID NO:483.

In another aspect, an isolated nucleic acid molecule is provided. The isolated nucleic acid molecule comprises a nucleotide sequence having 95% or greater sequence identity to the nucleotide sequence set forth in SEQ ID NO:484.

In another aspect, an isolated nucleic acid molecule is provided. The isolated nucleic acid molecule comprises a nucleotide sequence having 95% or greater sequence identity to the nucleotide sequence set forth in SEQ ID NO:485.

In another aspect, an isolated nucleic acid molecule is provided. The isolated nucleic acid molecule comprises a nucleotide sequence having 95% or greater sequence identity to the nucleotide sequence set forth in SEQ ID NO:486.

In another aspect, an isolated nucleic acid molecule is provided. The isolated nucleic acid molecule comprises a nucleotide sequence having 95% or greater sequence identity to the nucleotide sequence set forth in SEQ ID NO:487.

In another aspect, an isolated nucleic acid molecule is provided. The isolated nucleic acid molecule comprises a nucleotide sequence having 95% or greater sequence identity to the nucleotide sequence set forth in SEQ ID NO:488.

In another aspect, an isolated nucleic acid molecule is provided. The isolated nucleic acid molecule comprises a nucleotide sequence having 95% or greater sequence identity to the nucleotide sequence set forth in SEQ ID NO:489.

In another aspect, an isolated nucleic acid molecule is provided. The isolated nucleic acid molecule comprises a nucleotide sequence having 95% or greater sequence identity to the nucleotide sequence set forth in SEQ ID NO:490.

In another aspect, an isolated nucleic acid molecule is provided. The isolated nucleic acid molecule comprises a nucleotide sequence having 95% or greater sequence identity to the nucleotide sequence set forth in SEQ ID NO:491.

In another aspect, an isolated nucleic acid molecule is provided. The isolated nucleic acid molecule comprises a nucleotide sequence having 95% or greater sequence identity to the nucleotide sequence set forth in SEQ ID NO:492.

In another aspect, an isolated nucleic acid molecule is provided. The isolated nucleic acid molecule comprises a nucleotide sequence having 95% or greater sequence identity to the nucleotide sequence set forth in SEQ ID NO:493.

In another aspect, an isolated nucleic acid molecule is provided. The isolated nucleic acid molecule comprises a nucleotide sequence having 95% or greater sequence identity to the nucleotide sequence set forth in SEQ ID NO:494.

In another aspect, an isolated nucleic acid molecule is provided. The isolated nucleic acid molecule comprises a nucleotide sequence having 95% or greater sequence identity to the nucleotide sequence set forth in SEQ ID NO:495.

In another aspect, an isolated nucleic acid molecule is provided. The isolated nucleic acid molecule comprises a nucleotide sequence having 95% or greater sequence identity to the nucleotide sequence set forth in SEQ ID NO:496.

In another aspect, an isolated nucleic acid molecule is provided. The isolated nucleic acid molecule comprises a nucleotide sequence having 95% or greater sequence identity to the nucleotide sequence set forth in SEQ ID NO:497.

In another aspect, an isolated nucleic acid molecule is provided. The isolated nucleic acid molecule comprises a nucleotide sequence having 95% or greater sequence identity to the nucleotide sequence set forth in SEQ ID NO:498.

In another aspect, an isolated nucleic acid molecule is provided. The isolated nucleic acid molecule comprises a nucleotide sequence having 95% or greater sequence identity to the nucleotide sequence set forth in SEQ ID NO:499.

In another aspect, an isolated nucleic acid molecule is provided. The isolated nucleic acid molecule comprises a nucleotide sequence having 95% or greater sequence identity to the nucleotide sequence set forth in SEQ ID NO:500.

In another aspect, an isolated nucleic acid molecule is provided. The isolated nucleic acid molecule comprises a nucleotide sequence having 95% or greater sequence identity to the nucleotide sequence set forth in SEQ ID NO:501.

In another aspect, an isolated nucleic acid is provided. The isolated nucleic acid comprises a nucleotide sequence encoding a polypeptide having 80% or greater sequence identity to the amino acid sequence set forth in SEQ ID NO:502.

In another aspect, an isolated nucleic acid is provided. The isolated nucleic acid comprises a nucleotide sequence encoding a polypeptide having 80% or greater sequence identity to the amino acid sequence set forth in SEQ ID NO:503.

In another aspect, an isolated nucleic acid is provided. The isolated nucleic acid comprises a nucleotide sequence encoding a polypeptide having 80% or greater sequence identity to the amino acid sequence set forth in SEQ ID NO:504.

In another aspect, an isolated nucleic acid is provided. The isolated nucleic acid comprises a nucleotide sequence encoding a polypeptide having 80% or greater sequence identity to the amino acid sequence set forth in SEQ ID NO:505.

In another aspect, an isolated nucleic acid is provided. The isolated nucleic acid comprises a nucleotide sequence encoding a polypeptide having 80% or greater sequence identity to the amino acid sequence set forth in SEQ ID NO:507.

In another aspect, an isolated nucleic acid is provided. The isolated nucleic acid comprises a nucleotide sequence encoding a polypeptide having 80% or greater sequence identity to the amino acid sequence set forth in SEQ ID NO:509.

In another aspect, an isolated nucleic acid is provided. The isolated nucleic acid comprises a nucleotide sequence encoding a polypeptide having 80% or greater sequence identity to the amino acid sequence set forth in SEQ ID NO:511.

In another aspect, an isolated nucleic acid is provided. The isolated nucleic acid comprises a nucleotide sequence encoding a polypeptide having 80% or greater sequence identity to the amino acid sequence set forth in SEQ ID NO:513.

In another aspect, an isolated nucleic acid is provided. The isolated nucleic acid comprises a nucleotide sequence encoding a polypeptide having 80% or greater sequence identity to the amino acid sequence set forth in SEQ ID NO:514.

In another aspect, an isolated nucleic acid is provided. The isolated nucleic acid comprises a nucleotide sequence encoding a polypeptide having 80% or greater sequence identity to the amino acid sequence set forth in SEQ ID NO:515.

In another aspect, an isolated nucleic acid is provided. The isolated nucleic acid comprises a nucleotide sequence encoding a polypeptide having 80% or greater sequence identity to the amino acid sequence set forth in SEQ ID NO:517.

In another aspect, an isolated nucleic acid is provided. The isolated nucleic acid comprises a nucleotide sequence encoding a polypeptide having 80% or greater sequence identity to the amino acid sequence set forth in SEQ ID NO:519.

In another aspect, an isolated nucleic acid is provided. The isolated nucleic acid comprises a nucleotide sequence encoding a polypeptide having 80% or greater sequence identity to the amino acid sequence set forth in SEQ ID NO:521.

In another aspect, an isolated nucleic acid is provided. The isolated nucleic acid comprises a nucleotide sequence encoding a polypeptide having 80% or greater sequence identity to the amino acid sequence set forth in SEQ ID NO:525.

In another aspect, an isolated nucleic acid is provided. The isolated nucleic acid comprises a nucleotide sequence encoding a polypeptide having 80% or greater sequence identity to the amino acid sequence set forth in SEQ ID NO:526.

In another aspect, an isolated nucleic acid is provided. The isolated nucleic acid comprises a nucleotide sequence encoding a polypeptide having 80% or greater sequence identity to the amino acid sequence set forth in SEQ ID NO:527.

In another aspect, an isolated nucleic acid is provided. The isolated nucleic acid comprises a nucleotide sequence encoding a polypeptide having 80% or greater sequence identity to the amino acid sequence set forth in SEQ ID NO:529.

In another aspect, an isolated nucleic acid is provided. The isolated nucleic acid comprises a nucleotide sequence encoding a polypeptide having 80% or greater sequence identity to the amino acid sequence set forth in SEQ ID NO:531.

In another aspect, an isolated nucleic acid is provided. The isolated nucleic acid comprises a nucleotide sequence encoding a polypeptide having 80% or greater sequence identity to the amino acid sequence set forth in SEQ ID NO:532.

In another aspect, an isolated nucleic acid is provided. The isolated nucleic acid comprises a nucleotide sequence encoding a polypeptide having 80% or greater sequence identity to the amino acid sequence set forth in SEQ ID NO:533.

In another aspect, an isolated nucleic acid is provided. The isolated nucleic acid comprises a nucleotide sequence encoding a polypeptide having 80% or greater sequence identity to the amino acid sequence set forth in SEQ ID NO:534.

In another aspect, an isolated nucleic acid is provided. The isolated nucleic acid comprises a nucleotide sequence encoding a polypeptide having 80% or greater sequence identity to the amino acid sequence set forth in SEQ ID NO:541.

In another aspect, an isolated nucleic acid is provided. The isolated nucleic acid comprises a nucleotide sequence encoding a polypeptide having 80% or greater sequence identity to the amino acid sequence set forth in SEQ ID NO:545.

In another aspect, an isolated nucleic acid molecule is provided. The isolated nucleic acid molecule comprises a nucleotide sequence having 95% or greater sequence identity to the nucleotide sequence set forth in SEQ ID NO:546.

In another aspect, an isolated nucleic acid molecule is provided. The isolated nucleic acid molecule comprises a nucleotide sequence having 95% or greater sequence identity to the nucleotide sequence set forth in SEQ ID NO:547.

In another aspect, an isolated nucleic acid molecule is provided. The isolated nucleic acid molecule comprises a nucleotide sequence having 95% or greater sequence identity to the nucleotide sequence set forth in SEQ ID NO:549.

In another aspect, an isolated nucleic acid molecule is provided. The isolated nucleic acid molecule comprises a nucleotide sequence having 95% or greater sequence identity to the nucleotide sequence set forth in SEQ ID NO:551.

In another aspect, an isolated nucleic acid molecule is provided. The isolated nucleic acid molecule comprises a nucleotide sequence having 95% or greater sequence identity to the nucleotide sequence set forth in SEQ ID NO:553.

In another aspect, an isolated nucleic acid molecule is provided. The isolated nucleic acid molecule comprises a nucleotide sequence having 95% or greater sequence identity to the nucleotide sequence set forth in SEQ ID NO:555.

In another aspect, an isolated nucleic acid molecule is provided. The isolated nucleic acid molecule comprises a nucleotide sequence having 95% or greater sequence identity to the nucleotide sequence set forth in SEQ ID NO:556.

In another aspect, an isolated nucleic acid molecule is provided. The isolated nucleic acid molecule comprises a nucleotide sequence having 95% or greater sequence identity to the nucleotide sequence set forth in SEQ ID NO:557.

In another aspect, an isolated nucleic acid molecule is provided. The isolated nucleic acid molecule comprises a nucleotide sequence having 95% or greater sequence identity to the nucleotide sequence set forth in SEQ ID NO:559.

In another aspect, an isolated nucleic acid molecule is provided. The isolated nucleic acid molecule comprises a nucleotide sequence having 95% or greater sequence identity to the nucleotide sequence set forth in SEQ ID NO:561.

In another aspect, an isolated nucleic acid molecule is provided. The isolated nucleic acid molecule comprises a nucleotide sequence having 95% or greater sequence identity to the nucleotide sequence set forth in SEQ ID NO:562.

In another aspect, an isolated nucleic acid molecule is provided. The isolated nucleic acid molecule comprises a nucleotide sequence having 95% or greater sequence identity to the nucleotide sequence set forth in SEQ ID NO:564.

In another aspect, an isolated nucleic acid molecule is provided. The isolated nucleic acid molecule comprises a nucleotide sequence having 95% or greater sequence identity to the nucleotide sequence set forth in SEQ ID NO:565.

In another aspect, an isolated nucleic acid molecule is provided. The isolated nucleic acid molecule comprises a nucleotide sequence having 95% or greater sequence identity to the nucleotide sequence set forth in SEQ ID NO:566.

In another aspect, an isolated nucleic acid molecule is provided. The isolated nucleic acid molecule comprises a nucleotide sequence having 95% or greater sequence identity to the nucleotide sequence set forth in SEQ ID NO:567.

In another aspect, an isolated nucleic acid molecule is provided. The isolated nucleic acid molecule comprises a nucleotide sequence having 95% or greater sequence identity to the nucleotide sequence set forth in SEQ ID NO:569.

In another aspect, an isolated nucleic acid molecule is provided. The isolated nucleic acid molecule comprises a nucleotide sequence having 95% or greater sequence identity to the nucleotide sequence set forth in SEQ ID NO:570.

In another aspect, an isolated nucleic acid molecule is provided. The isolated nucleic acid molecule comprises a nucleotide sequence having 95% or greater sequence identity to the nucleotide sequence set forth in SEQ ID NO:571.

In another aspect, an isolated nucleic acid molecule is provided. The isolated nucleic acid molecule comprises a nucleotide sequence having 95% or greater sequence identity to the nucleotide sequence set forth in SEQ ID NO:572.

In another aspect, an isolated nucleic acid molecule is provided. The isolated nucleic acid molecule comprises a nucleotide sequence having 95% or greater sequence identity to the nucleotide sequence set forth in SEQ ID NO:573.

In another aspect, an isolated nucleic acid molecule is provided. The isolated nucleic acid molecule comprises a nucleotide sequence having 95% or greater sequence identity to the nucleotide sequence set forth in SEQ ID NO:575.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DESCRIPTION OF THE DRAWINGS

FIG. 1 is an alignment of Ceres Clone 41573 (SEQ ID NO:81) with homologous and/or orthologous amino acid sequences Ceres Clone:1560908 (SEQ ID NO:82), gi|2739168 (SEQ ID NO:83), Ceres Clone:1314177 (SEQ ID NO:85), Ceres Clone 1371577 (SEQ ID NO:87), and gi|50920801 (SEQ ID NO:89). The consensus sequence determined by the alignment is set forth.

FIG. 2 is an alignment of Ceres Clone 25429 (SEQ ID NO:94) with homologous and/or orthologous amino acid sequences Ceres Annot:1488311 (SEQ ID NO:96), Ceres Clone:953928 (SEQ ID NO:97), Ceres Clone:524682 (SEQ ID NO:98), Ceres Clone:1609735 (SEQ ID NO:99), gi|42565379 (SEQ ID NO:102), Ceres Clone:426736 (SEQ ID NO:103), and gi|24473796 (SEQ ID NO:107). The consensus sequence determined by the alignment is set forth.

FIG. 3 is an alignment of Ceres Clone 5750 (SEQ ID NO:111) with homologous and/or orthologous amino acid sequences gi|42362268 (SEQ ID NO:112), gi|27435806 (SEQ ID NO:116), gi|45935118 (SEQ ID NO:119), Ceres Clone:1017141 (SEQ ID NO:120), Ceres Clone:1448636 (SEQ ID NO:121), gi|50919707 (SEQ ID NO:122), Ceres Clone:947192 (SEQ ID NO:127), and gi|55978016 (SEQ ID NO:133). The consensus sequence determined by the alignment is set forth.

FIG. 5 is an alignment of Ceres Clone 121021 (SEQ ID NO:152) with homologous and/or orthologous amino acid sequences Ceres Annot: 1501628 (SEQ ID NO:154) and Ceres Clone:1121512 (SEQ ID NO:157).

FIG. 6 is an alignment of Ceres Clone 158765 (SEQ ID NO:159) with homologous and/or orthologous amino acid sequences gi|5669656 (SEQ ID NO:161), Ceres Clone: 754061 (SEQ ID NO:162), Ceres Clone:537752 (SEQ ID NO:164), Ceres Clone:282892 (SEQ ID NO:166), and gi|50925813 (SEQ ID NO:169).

FIG. 7 is an alignment of Ceres Clone 16403 (SEQ ID NO:171) with homologous and/or orthologous amino acid sequences Ceres Clone:611156 (SEQ ID NO:172) and Ceres Annot:1464944 (SEQ ID NO:174).

FIG. 8 is an alignment of Ceres Clone 28635 (SEQ ID NO:178) with homologous and/or orthologous amino acid sequences gi|2463569 (SEQ ID NO:179), Ceres Annot: 1514021 (SEQ ID NO:181), gi|55710094 (SEQ ID NO:182), gi|75859951 (SEQ ID NO:185), gi|1449163 (SEQ ID NO:186), gi|28208268 (SEQ ID NO:188), gi|41224629 (SEQ ID NO:189), gi|27475614 (SEQ ID NO:190), and gi|38426486 (SEQ ID NO:191).

FIG. 9 is an alignment of Clone 35698 (SEQ ID NO:193) with homologous and/or orthologous amino acid sequences Clone 1380019·T (SEQ ID NO:266), gi|441457·T (SEQ ID NO:268), Ceres Annot:1483290·T (SEQ ID NO:270), gi|40287554·T (SEQ ID NO:271), gi|28569265·T (SEQ ID NO:274), gi|22597164·T (SEQ ID NO:278), Clone 617835·T (SEQ ID NO:279), gi|5762457·T (SEQ ID NO:281), gi|77416935·T (SEQ ID NO:284), gi|28569267·T (SEQ ID NO:285), gi|50906823·T (SEQ ID NO:295), gi|30025160·T (SEQ ID NO:315), gi|54402104·T (SEQ ID NO:321), gi|52851174·T (SEQ ID NO:326), and gi|4100646·T (SEQ ID NO:330).

FIG. 10 is an alignment of Ceres Clone 36412 (SEQ ID NO:332) with homologous and/or orthologous amino acid sequences Ceres Annot:1467033 (SEQ ID NO:335) and Ceres Clone:1641329 (SEQ ID NO:338).

FIG. 11 is an alignment of Ceres Clone 4829 (SEQ ID NO:346) with homologous and/or orthologous amino acid sequences Ceres Annot:1485102 (SEQ ID NO:350), Ceres Clone:1646533 (SEQ ID NO:351), gi|29371519 (SEQ ID NO:352), gi|45935148 (SEQ ID NO:354), Ceres Clone: 359934 (SEQ ID NO:355), and Ceres Clone:839270 (SEQ ID NO:357).

FIG. 12 is an alignment of Ceres Clone 5426 (SEQ ID NO:359) with homologous and/or orthologous amino acid sequences Ceres Clone:1123542 (SEQ ID NO:360), Ceres Annot:1499194 (SEQ ID NO:368), and Ceres Clone:557065 (SEQ ID NO:371).

DETAILED DESCRIPTION

Figure 4:
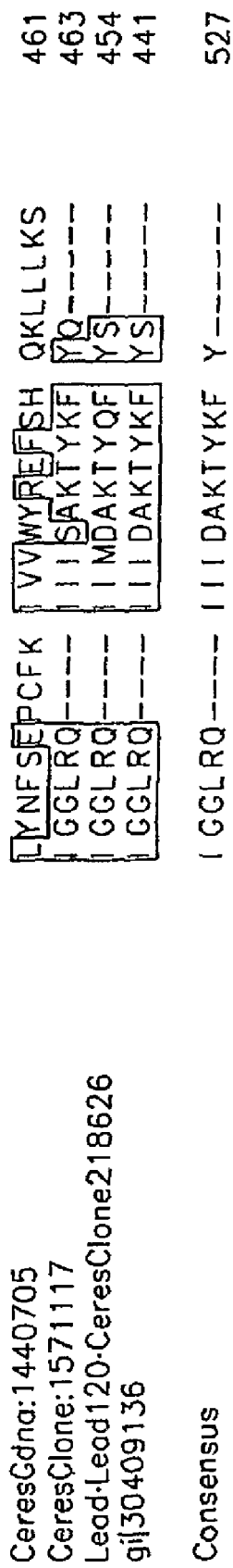
FIG. 4 is an alignment of Ceres Clone 218626 (SEQ ID NO:136) with homologous and/or orthologous amino acid sequences gi|30409136 (SEQ ID NO:137), Ceres Clone: 1571117 (SEQ ID NO:139), and Ceres Annot:1440705 (SEQ ID NO:142). The consensus sequence determined by the alignment is set forth.

The invention features methods and materials related to modulating (e.g., increasing or decreasing) oil levels in plants. In some embodiments, the plants may also have modulated levels of protein. The methods can include transforming a plant cell with a nucleic acid encoding an oil-modulating polypeptide, wherein expression of the polypeptide results in a modulated level of oil. Plant cells produced using such methods can be grown to produce plants having an increased or decreased oil content. Seeds from such plants may be used to produce, for example, foodstuffs and animal feed having an increased oil content. Producing oil from seeds having an increased oil content can allow manufacturers to increase oil yields.

Polypeptides

The term "polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. The term "amino acid" refers to natural and/or unnatural or synthetic amino acids, including D/L optical isomers. Full-length proteins, analogs, mutants, and fragments thereof are encompassed by this definition.

Polypeptides described herein include oil-modulating polypeptides. Oil-modulating polypeptides can be effective to modulate oil levels when expressed in a plant or plant cell. Modulation of the level of oil can be either an increase or a decrease in the level of oil relative to the corresponding level in a control plant.

An oil-modulating polypeptide can be an enzyme, such as an aldose 1-epimerase, a squalene/phytoene synthase, a ubiquitin-conjugating enzyme, or a cytochrome p450 enzyme. An oil-modulating polypeptide can also be a ribosomal polypeptide, such as a 60S acidic ribosomal protein or a ribosomal protein L28e. An oil-modulating polypeptide can also be a regulatory polypeptide, such as a cyclin-dependent kinase regulatory subunit or a PsbP protein subunit of photosystem II (PSII). An oil-modulating polypeptide can also be a transporter polypeptide, such as a tryptophan/tyrosine permease or a major facilitator superfamily (MFS) transporter. An oil-modulating polypeptide can also be a transcription factor polypeptide, such as an AP2 domain-containing transcription factor polypeptide.

An oil-modulating polypeptide can be an enzyme involved in carbohydrate metabolism, such as an aldose 1-epimerase family polypeptide. Aldose 1-epimerase catalyzes the interconversion of the alpha- and beta-anomers of hexose sugars such as glucose and galactose. SEQ ID NO:81 sets forth the amino acid sequence of an *Arabidopsis* clone, identified herein as Ceres Clone 41573 (SEQ ID NO:80), that is predicted to encode an aldose 1-epimerase family polypeptide. An oil-modulating polypeptide can comprise the amino acid sequence set forth in SEQ ID NO:81. Alternatively, an oil-modulating polypeptide can be a homolog, ortholog, or variant of the polypeptide having the amino acid sequence set forth in SEQ ID NO:81. For example, an oil-modulating polypeptide can have an amino acid sequence with at least 45% sequence identity, e.g., 45%, 50%, 55%, 60%, 65%, 70%, 75%, 80%, 85%, 90%, 95%, 97%, 98%, or 99% sequence identity, to the amino acid sequence set forth in SEQ ID NO:81.

Figure 1:
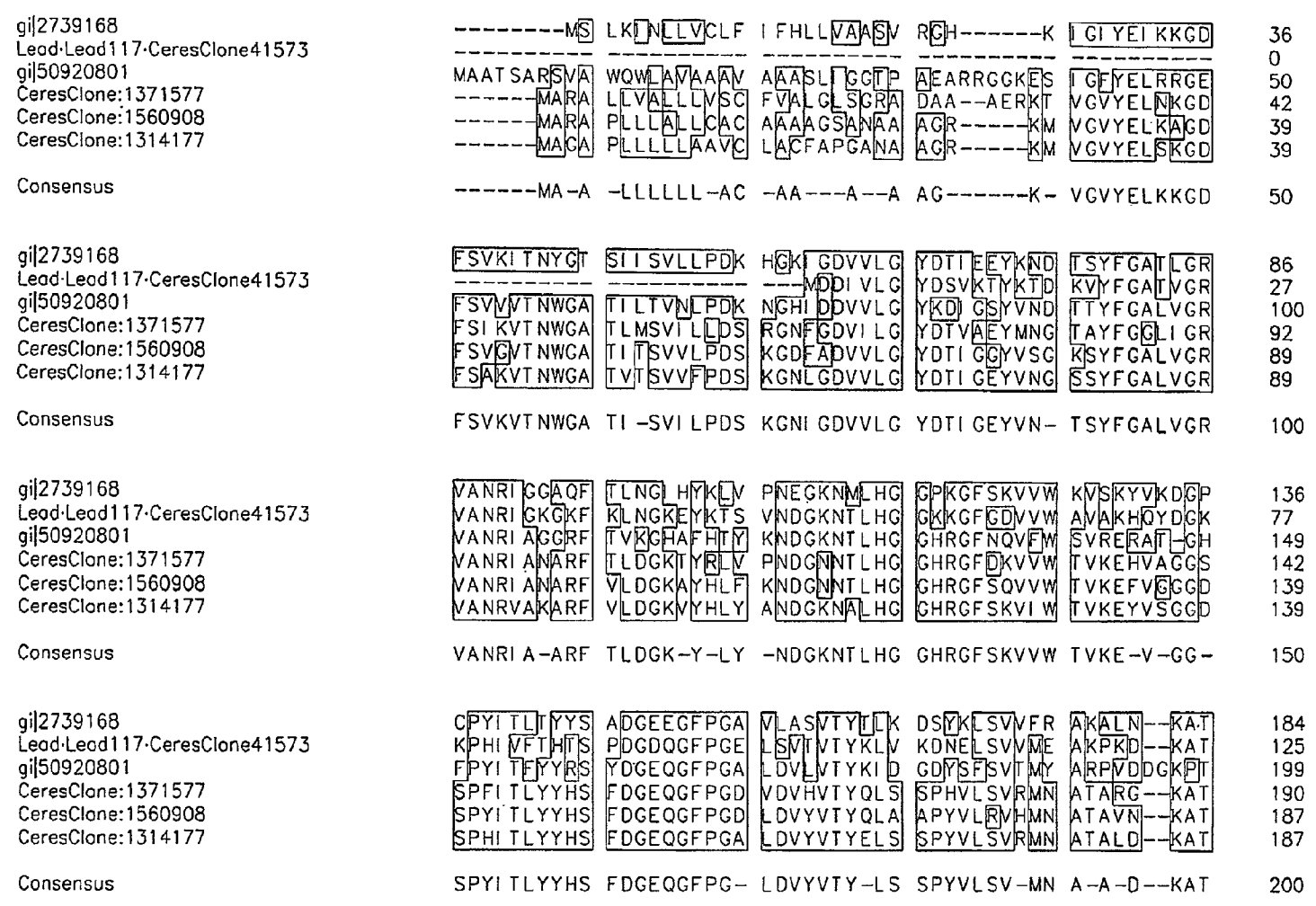

Amino acid sequences of homologs and/or orthologs of the polypeptide having the amino acid sequence set forth in SEQ ID NO:81 are provided in FIG. 1, along with a consensus sequence. A consensus amino acid sequence for such homologs and/or orthologs was determined by aligning amino acid sequences, e.g., amino acid sequences related to SEQ ID NO:81, from a variety of species and determining the most common amino acid or type of amino acid at each position. For example, the alignment in FIG. 1 provides the amino acid sequences of Ceres Clone 41573 (SEQ ID NO:81), Ceres Clone:1560908 (SEQ ID NO:82), gi|2739168 (SEQ ID NO:83), Ceres Clone:1314177 (SEQ ID NO:85), Ceres Clone 1371577 (SEQ ID NO:87), and gi|50920801 (SEQ ID NO:89). Other homologs and/or orthologs include Ceres CLONE ID no. 399052 (SEQ ID NO:84), Public GI no. 15824567 (SEQ ID NO:86), Public GI no. 15824565 (SEQ ID NO:88), Public GI no. 50909807 (SEQ ID NO:90), Ceres CLONE ID no. 639223 (SEQ ID NO:91), Public GI no. 37531218 (SEQ ID NO:92), and Ceres Clone:1476735 (SEQ ID NO:502).

In some cases, an oil-modulating polypeptide includes a polypeptide having at least 80% sequence identity, e.g., 80%, 85%, 90%, 95%, 97%, 98%, or 99% sequence identity, to an amino acid sequence corresponding to SEQ ID NO:82, SEQ ID NO:83, SEQ ID NO:84, SEQ ID NO:85, SEQ ID NO:86, SEQ ID NO:87, SEQ ID NO:88, SEQ ID NO:89, SEQ ID NO:90, SEQ ID NO:91, SEQ ID NO:92, SEQ ID NO:502, or the consensus sequence set forth in FIG. 1.

An oil-modulating polypeptide can be a ribosomal polypeptide, such as a 60S acidic ribosomal polypeptide. SEQ ID NO:94 sets forth the amino acid sequence of an *Arabidopsis* clone, identified herein as Ceres Clone 25429 (SEQ ID NO:93), that is predicted to encode a 60S acidic ribosomal polypeptide. An oil-modulating polypeptide can comprise the amino acid sequence set forth in SEQ ID NO:94. Alternatively, an oil-modulating polypeptide can be a homolog, ortholog, or variant of the polypeptide having the amino acid sequence set forth in SEQ ID NO:94. For example, an oil-modulating polypeptide can have an amino acid sequence with at least 60% sequence identity, e.g., 60%, 65%, 70%, 75%, 80%, 85%, 90%, 95%, 97%, 98%, or 99% sequence identity, to the amino acid sequence set forth in SEQ ID NO:94.

Amino acid sequences of homologs and/or orthologs of the polypeptide having the amino acid sequence set forth in SEQ ID NO:94 are provided in FIG. 2, along with a consensus sequence. A consensus amino acid sequence for such homologs and/or orthologs was determined by aligning amino acid sequences, e.g., amino acid sequences related to SEQ ID NO:94, from a variety of species and determining the most common amino acid or type of amino acid at each position. For example, the alignment in FIG. 2 provides the amino acid sequences of Ceres Clone 25429 (SEQ ID NO:94), Ceres Annot:1488311 (SEQ ID NO:96), Ceres Clone:953928 (SEQ ID NO:97), Ceres Clone:524682 (SEQ ID NO:98), Ceres Clone:1609735 (SEQ ID NO:99), gi|42565379 (SEQ ID NO:102), Ceres Clone:426736 (SEQ ID NO:103), and gi|24473796 (SEQ ID NO:107). Other homologs and/or orthologs include Ceres CLONE ID no. 949174 (SEQ ID NO:100), Ceres CLONE ID no. 1299820 (SEQ ID NO:101), Ceres CLONE ID no. 1094375 (SEQ ID NO:104), Ceres CLONE ID no. 691062 (SEQ ID NO:105), Public GI no. 47026878 (SEQ ID NO:106), Ceres Annot:

1465437_PRT (SEQ ID NO:109), Ceres Clone:1798334 (SEQ ID NO:503), Ceres Clone:1886478 (SEQ ID NO:504), Ceres Clone:1727128 (SEQ ID NO:505), and gi|730583 (SEQ ID NO:506).

In some cases, an oil-modulating polypeptide includes a polypeptide having at least 80% sequence identity, e.g., 80%, 85%, 90%, 95%, 97%, 98%, or 99% sequence identity, to an amino acid sequence corresponding to SEQ ID NO:96, SEQ ID NO:97, SEQ ID NO:98, SEQ ID NO:99, SEQ ID NO:100, SEQ ID NO:101, SEQ ID NO:102, SEQ ID NO:103, SEQ ID NO:104, SEQ ID NO:105, SEQ ID NO:106, SEQ ID NO:107, SEQ ID NO:109, SEQ ID NO:503, SEQ ID NO:504, SEQ ID NO:505, SEQ ID NO:506, or the consensus sequence set forth in FIG. 2.

An oil-modulating polypeptide can be a cyclin-dependent kinase regulatory subunit. In eukaryotes, cyclin-dependent protein kinases interact with cyclins to regulate cell cycle progression. The proteins bind to a regulatory subunit, cyclin-dependent kinase regulatory subunit (CKS), which is essential for their function. SEQ ID NO:111 sets forth the amino acid sequence of an *Arabidopsis* clone, identified herein as Ceres Clone 5750 (SEQ ID NO:110), that is predicted to encode a cyclin-dependent kinase regulatory subunit. An oil-modulating polypeptide can comprise the amino acid sequence set forth in SEQ ID NO:111. Alternatively, an oil-modulating polypeptide can be a homolog, ortholog, or variant of the polypeptide having the amino acid sequence set forth in SEQ ID NO:111. For example, an oil-modulating polypeptide can have an amino acid sequence with at least 75% sequence identity, e.g., 75%, 80%, 85%, 90%, 95%, 97%, 98%, or 99% sequence identity, to the amino acid sequence set forth in SEQ ID NO:111.

Amino acid sequences of homologs and/or orthologs of the polypeptide having the amino acid sequence set forth in SEQ ID NO:111 are provided in FIG. 3, along with a consensus sequence. A consensus amino acid sequence for such homologs and/or orthologs was determined by aligning amino acid sequences, e.g., amino acid sequences related to SEQ ID NO:111, from a variety of species and determining the most common amino acid or type of amino acid at each position. For example, the alignment in FIG. 3 provides the amino acid sequences of Ceres Clone 5750 (SEQ ID NO:111), gi|42362268 (SEQ ID NO:112), gi|27435806 (SEQ ID NO:116), gi|45935118 (SEQ ID NO:119), Ceres Clone:1017141 (SEQ ID NO:120), Ceres Clone: 1448636 (SEQ ID NO:121), gi|50919707 (SEQ ID NO:122), Ceres Clone:947192 (SEQ ID NO:127), and gi|55978016 (SEQ ID NO:133). Other homologs and/or orthologs include Ceres CLONE ID no. 709027 (SEQ ID NO:113), Ceres CLONE ID no. 853298 (SEQ ID NO:114), Ceres CLONE ID no. 1417425 (SEQ ID NO:115), Ceres Annot:1481954 (SEQ ID NO:118), Public GI no. 40641585 (SEQ ID NO:123), Public GI no. 38566522 (SEQ ID NO:124), Ceres CLONE ID no. 1338131 (SEQ ID NO:125), Ceres CLONE ID no. 300692 (SEQ ID NO:126), Ceres CLONE ID no. 1465004 (SEQ ID NO:128), Ceres CLONE ID no. 1122958 (SEQ ID NO:129), Ceres CLONE ID no. 944737 (SEQ ID NO:130), Ceres CLONE ID no. 217797 (SEQ ID NO:131), Ceres CLONE ID no. 520185 (SEQ ID NO:132), Ceres CLONE ID no. 1436585 (SEQ ID NO:134), Ceres Clone:1777369 (SEQ ID NO:507), Ceres Clone:1744578 (SEQ ID NO:508), Ceres Clone:100008703 (SEQ ID NO:509), and Ceres Clone: 1723582 (SEQ ID NO:510).

In some cases, an oil-modulating polypeptide includes a polypeptide having at least 80% sequence identity, e.g., 80%, 85%, 90%, 95%, 97%, 98%, or 99% sequence identity, to an amino acid sequence corresponding to SEQ ID NO:112, SEQ ID NO:113, SEQ ID NO:114, SEQ ID NO:115, SEQ ID NO:116, SEQ ID NO:118, SEQ ID NO:119, SEQ ID NO:120, SEQ ID NO:121, SEQ ID NO:122, SEQ ID NO:123, SEQ ID NO:124, SEQ ID NO:125, SEQ ID NO:126, SEQ ID NO:127, SEQ ID NO:128, SEQ ID NO:129, SEQ ID NO:130, SEQ ID NO:131, SEQ ID NO:132, SEQ ID NO:133, SEQ ID NO:134, SEQ ID NO:507, SEQ ID NO:508, SEQ ID NO:509, SEQ ID NO:510, or the consensus sequence set forth in FIG. 3.

An oil-modulating polypeptide can be a tryptophan/tyrosine permease family polypeptide. Amino acid permeases are integral membrane proteins involved in the transport of amino acids into the cell. SEQ ID NO:136 sets forth the amino acid sequence of a *Zea mays* clone, identified herein as Ceres Clone 218626 (SEQ ID NO:135), that is predicted to encode a tryptophan/tyrosine permease family polypeptide. The tryptophan/tyrosine permease family of proteins is characterized by, inter alia, the presence of several membrane-spanning domains. Members of the tryptophan/tyrosine permease family sometimes have homology to other permeases and transporters. An oil-modulating polypeptide can comprise the amino acid sequence set forth in SEQ ID NO:136. Alternatively, an oil-modulating polypeptide can be a homolog, ortholog, or variant of the polypeptide having the amino acid sequence set forth in SEQ ID NO:136. For example, an oil-modulating polypeptide can have an amino acid sequence with at least 70% sequence identity, e.g., 70%, 75%, 80%, 85%, 90%, 95%, 97%, 98%, or 99% sequence identity, to the amino acid sequence set forth in SEQ ID NO:136.

Amino acid sequences of homologs and/or orthologs of the polypeptide having the amino acid sequence set forth in SEQ ID NO:136 are provided in FIG. 4, along with a consensus sequence. A consensus amino acid sequence for such homologs and/or orthologs was determined by aligning amino acid sequences, e.g., amino acid sequences related to SEQ ID NO:136, from a variety of species and determining the most common amino acid or type of amino acid at each position. For example, the alignment in FIG. 4 provides the amino acid sequences of Ceres Clone 218626 (SEQ ID NO:136), gi|30409136 (SEQ ID NO:137), Ceres Clone: 1571117 (SEQ ID NO:139), and Ceres Annot:1440705 (SEQ ID NO:142). Other homologs and/or orthologs include Public GI no. 50940751 (SEQ ID NO:138), Ceres CLONE ID no. 424395 (SEQ ID NO:140), Ceres Annot:1493584 (SEQ ID NO:144), Ceres Annot:1463076 (SEQ ID NO:146), Ceres CLONE ID no. 1002421 (SEQ ID NO:147), Ceres Annot: 1516369 (SEQ ID NO:149), Public GI no. 30693666 (SEQ ID NO:150), and Ceres Clone:1796001 (SEQ ID NO:511).

In some cases, an oil-modulating polypeptide includes a polypeptide having at least 80% sequence identity, e.g., 80%, 85%, 90%, 95%, 97%, 98%, or 99% sequence identity, to an amino acid sequence corresponding to SEQ ID NO:137, SEQ ID NO:138, SEQ ID NO:139, SEQ ID NO:140, SEQ ID NO:142, SEQ ID NO:144, SEQ ID NO:146, SEQ ID NO:147, SEQ ID NO:149, SEQ ID NO:150, SEQ ID NO:511, or the consensus sequence set forth in FIG. 4.

An oil-modulating polypeptide can be a polypeptide that does not have homology to an existing protein family based on Pfam analysis. SEQ ID NO:152 sets forth the amino acid sequence of an *Arabidopsis* clone, identified herein as Ceres Clone 121021 (SEQ ID NO:151), that is predicted to encode a polypeptide that does not have homology to an existing protein family based on Pfam analysis. An oil-modulating polypeptide can comprise the amino acid sequence set forth in SEQ ID NO:152. Alternatively, an oil-modulating polypeptide can be a homolog having at least 45% sequence identity, e.g., 45%, 50%, 55%, 60%, 65%, 70%, 75%, 80%, 85%, 90%, 95%, 97%, 98%, or 99% sequence identity, to the amino acid sequence set forth in SEQ ID NO:152.

Amino acid sequences of homologs of the polypeptide having the amino acid sequence set forth in SEQ ID NO:152 are provided in FIG. 5, along with a consensus sequence. A consensus amino acid sequence for such homologs was determined by aligning amino acid sequences, e.g., amino acid sequences related to SEQ ID NO:152, from a variety of species and determining the most common amino acid or type of amino acid at each position. For example, the alignment in FIG. 5 provides the amino acid sequences of Ceres Clone 121021 (SEQ ID NO:152), Ceres Annot: 1501628 (SEQ ID NO:154) and Ceres Clone: 1121512 (SEQ ID NO:157). Other homologs include Ceres Annot:1519046 (SEQ ID NO:156).

In some cases, an oil-modulating polypeptide includes a polypeptide having at least 80% sequence identity, e.g., 80%, 85%, 90%, 95%, 97%, 98%, or 99% sequence identity, to an amino acid sequence corresponding to SEQ ID NO:154, SEQ ID NO:156, SEQ ID NO:157, or the consensus sequence set forth in FIG. 5.

SEQ ID NO:159 sets forth the amino acid sequence of another *Arabidopsis* clone, identified herein as Ceres Clone 158765 (SEQ ID NO:158), that is predicted to encode a polypeptide that does not have homology to an existing protein family based on Pfam analysis. An oil-modulating polypeptide can comprise the amino acid sequence set forth in SEQ ID NO:159. Alternatively, an oil-modulating polypeptide can be a homolog having at least 45% sequence identity, e.g., 45%, 50%, 55%, 60%, 65%, 70%, 75%, 80%, 85%, 90%, 95%, 97%, 98%, or 99% sequence identity, to the amino acid sequence set forth in SEQ ID NO:159.

Amino acid sequences of homologs of the polypeptide having the amino acid sequence set forth in SEQ ID NO:159 are provided in FIG. 6, along with a consensus sequence. A consensus amino acid sequence for such homologs was determined by aligning amino acid sequences, e.g., amino acid sequences related to SEQ ID NO:159, from a variety of species and determining the most common amino acid or type of amino acid at each position. For example, the alignment in FIG. 6 provides the amino acid sequences of Ceres Clone 158765 (SEQ ID NO:159), gi|5669656 (SEQ ID NO:161), Ceres Clone:754061 (SEQ ID NO:162), Ceres Clone:537752 (SEQ ID NO:164), Ceres Clone:282892 (SEQ ID NO:166), and gi|50925813 (SEQ ID NO:169). Other homologs include Public GI no. 32562996 (SEQ ID NO:160), Ceres CLONE ID no. 1329861 (SEQ ID NO:163), Ceres CLONE ID no. 1322549 (SEQ ID NO:165), Ceres CLONE ID no. 284046 (SEQ ID NO:167), Ceres CLONE ID no. 1388825 (SEQ ID NO:168), and Ceres Clone:1839717 (SEQ ID NO:545).

In some cases, an oil-modulating polypeptide includes a polypeptide having at least 80% sequence identity, e.g., 80%, 85%, 90%, 95%, 97%, 98%, or 99% sequence identity, to an amino acid sequence corresponding to SEQ ID NO:160, SEQ ID NO:161, SEQ ID NO:162, SEQ ID NO:163, SEQ ID NO:164, SEQ ID NO:165, SEQ ID NO:166, SEQ ID NO:167, SEQ ID NO:168, SEQ ID NO:169, SEQ ID NO:545, or the consensus sequence set forth in FIG. 6.

An oil-modulating polypeptide can be a PsbP polypeptide. A PsbP polypeptide is a subunit of photosystem II (PSII) that is reported to be essential for the regulation and stabilization of PSII in higher plants. SEQ ID NO:171 sets forth the amino acid sequence of an *Arabidopsis* clone, identified herein as Ceres Clone 16403 (SEQ ID NO:170), that is predicted to encode a PsbP polypeptide. An oil-modulating polypeptide can comprise the amino acid sequence set forth in SEQ ID NO:171. Alternatively, an oil-modulating polypeptide can be a homolog, ortholog, or variant of the polypeptide having the amino acid sequence set forth in SEQ ID NO:171. For example, an oil-modulating polypeptide can have an amino acid sequence with at least 50% sequence identity, e.g., 50%, 55%, 60%, 65%, 70%, 75%, 80%, 85%, 90%, 95%, 97%, 98%, or 99% sequence identity, to the amino acid sequence set forth in SEQ ID NO:171.

Amino acid sequences of homologs and/or orthologs of the polypeptide having the amino acid sequence set forth in SEQ ID NO:171 are provided in FIG. 7, along with a consensus sequence. A consensus amino acid sequence for such homologs and/or orthologs was determined by aligning amino acid sequences, e.g., amino acid sequences related to SEQ ID NO:171, from a variety of species and determining the most common amino acid or type of amino acid at each position. For example, the alignment in FIG. 7 provides the amino acid sequences of Ceres Clone 16403 (SEQ ID NO:171), Ceres Clone:611156 (SEQ ID NO:172), Ceres Annot:1464944 (SEQ ID NO:174), Ceres Clone:1728680 (SEQ ID NO:530), Ceres Clone:1807796 (SEQ ID NO:531), Ceres Clone:1771837 (SEQ ID NO:532), and Ceres Clone: 1773482 (SEQ ID NO:533).

In some cases, an oil-modulating polypeptide includes a polypeptide having at least 80% sequence identity, e.g., 80%, 85%, 90%, 95%, 97%, 98%, or 99% sequence identity, to an amino acid sequence corresponding to SEQ ID NO:172, SEQ ID NO:174, SEQ ID NO:530, SEQ ID NO:531, SEQ ID NO:532, SEQ ID NO:533, or the consensus sequence set forth in FIG. 7.

An oil-modulating polypeptide can be a transcription factor that contains an AP2 (APETALA2) DNA-binding domain. AP2 is one of the prototypic members of a family of transcription factors unique to plants, whose distinguishing characteristic is that they contain the so-called AP2 DNA-binding domain. SEQ ID NO:176 sets forth the amino acid sequence of an *Arabidopsis* clone, identified herein as Ceres Clone 19244 (SEQ ID NO:175), that is predicted to encode a transcription factor containing an AP2 DNA-binding domain. An oil-modulating polypeptide can comprise the amino acid sequence set forth in SEQ ID NO:176. Alternatively, an oil-modulating polypeptide can be a homolog, ortholog, or variant of the polypeptide having the amino acid sequence set forth in SEQ ID NO:176. For example, an oil-modulating polypeptide can have an amino acid sequence with at least 40% sequence identity, e.g., 40%, 45%, 50%, 55%, 60%, 65%, 70%, 75%, 80%, 85%, 90%, 95%, 97%, 98%, or 99% sequence identity, to the amino acid sequence set forth in SEQ ID NO:176.

An oil-modulating polypeptide can be a squalene/phytoene synthase. Squalene synthase catalyzes the conversion of two molecules of farnesyl diphosphate into squalene, which is the first committed step in the cholesterol biosynthetic pathway. Phytoene synthase catalyzes the conversion of two molecules of geranylgeranyl diphosphate into phytoene, which is the second step in the biosynthesis of carotenoids from isopentenyl diphosphate. SEQ ID NO:178 sets forth the amino acid sequence of an *Arabidopsis* clone, identified herein as Ceres Clone 28635 (SEQ ID NO:177), that is predicted to encode a squalene/phytoene synthase. An oil-modulating polypeptide can comprise the amino acid sequence set forth in SEQ ID NO:178. Alternatively, an oil-modulating polypeptide can be a homolog, ortholog, or variant of the polypeptide having the amino acid sequence set forth in SEQ ID NO:178. For example, an oil-modulating polypeptide can have an amino acid sequence with at least 70% sequence identity, e.g., 70%, 75%, 80%, 85%, 90%, 95%, 97%, 98%, or 99% sequence identity, to the amino acid sequence set forth in SEQ ID NO:178.

Amino acid sequences of homologs and/or orthologs of the polypeptide having the amino acid sequence set forth in SEQ ID NO:178 are provided in FIG. 8, along with a consensus sequence. A consensus amino acid sequence for such homologs and/or orthologs was determined by aligning amino acid sequences, e.g., amino acid sequences related to SEQ ID NO:178, from a variety of species and determining the most common amino acid or type of amino acid at each position. For example, the alignment in FIG. 8 provides the amino acid sequences of Ceres Clone 28635 (SEQ ID NO:178), gi|2463569 (SEQ ID NO:179), Ceres Annot: 1514021 (SEQ ID NO:181), gi|55710094 (SEQ ID NO:182), gi|75859951 (SEQ ID NO:185), gi|1449163 (SEQ ID NO:186), gi|28208268 (SEQ ID NO:188), gi|41224629 (SEQ ID NO:189), gi|27475614 (SEQ ID NO:190), and gi|38426486 (SEQ ID NO:191). Other homologs and/or orthologs include Ceres Annot:1503464 (SEQ ID NO:184) and Public GI no. 1449165 (SEQ ID NO:187), Ceres Clone: 1920025 (SEQ ID NO:534), gi|110293133 (SEQ ID NO:535), gi|5360655 (SEQ ID NO:536), gi|4426953 (SEQ ID NO:537), gi|1552717 (SEQ ID NO:538), gi|66393825 (SEQ ID NO:539), gi|1706774 (SEQ ID NO:540), Ceres Clone:1749989 (SEQ ID NO:541), gi|115456049 (SEQ ID NO:542), gi|2463567 (SEQ ID NO:543), and Ceres Clone: 706088 (SEQ ID NO:544).

In some cases, an oil-modulating polypeptide includes a polypeptide having at least 80% sequence identity, e.g., 80%, 85%, 90%, 95%, 97%, 98%, or 99% sequence identity, to an amino acid sequence corresponding to SEQ ID NO:179, SEQ ID NO:181, SEQ ID NO:182, SEQ ID NO:184, SEQ ID NO:185, SEQ ID NO:186, SEQ ID NO:187, SEQ ID NO:188, SEQ ID NO:189, SEQ ID NO:190, SEQ ID NO:191, SEQ ID NO:534, SEQ ID NO:535, SEQ ID NO:536, SEQ ID NO:537, SEQ ID NO:538, SEQ ID NO:539, SEQ ID NO:540, SEQ ID NO:541, SEQ ID NO:542, SEQ ID NO:543, SEQ ID NO:544, or the consensus sequence set forth in FIG. 8.

An oil-modulating polypeptide can be an ubiquitin-conjugating enzyme. An ubiquitin-conjugating enzyme (E2) is one of at least three enzymes involved in ubiquitination. The E2 enzyme transfers a ubiquitin moiety directly to a substrate, or to a ubiquitin ligase (E3). E2 enzymes are broadly grouped into four classes: class I enzymes contain the catalytic core domain (UBC) having an active site cysteine, class II enzymes possess a UBC and a C-terminal extension, class III enzymes possess a UBC and an N-terminal extension, and class IV enzymes possess a UBC and both N- and C-terminal extensions. These extensions appear to be important for some subfamily function, including E2 localization and protein-protein interactions. In addition, there are proteins with an E2-like fold that are devoid of catalytic activity, but which appear to assist in poly-ubiquitin chain formation. SEQ ID NO:193 sets forth the amino acid sequence of an *Arabidopsis* clone, identified herein as Ceres Clone 35698 (SEQ ID NO:192), that is predicted to encode a ubiquitin-conjugating enzyme. An oil-modulating polypeptide can comprise the amino acid sequence set forth in SEQ ID NO:193. Alternatively, an oil-modulating polypeptide can be a homolog, ortholog, or variant of the polypeptide having the amino acid sequence set forth in SEQ ID NO:193. For example, an oil-modulating polypeptide can have an amino acid sequence with at least 75% sequence identity, e.g., 75%, 80%, 85%, 90%, 95%, 97%, 98%, or 99% sequence identity, to the amino acid sequence set forth in SEQ ID NO:193.

Figure 9:
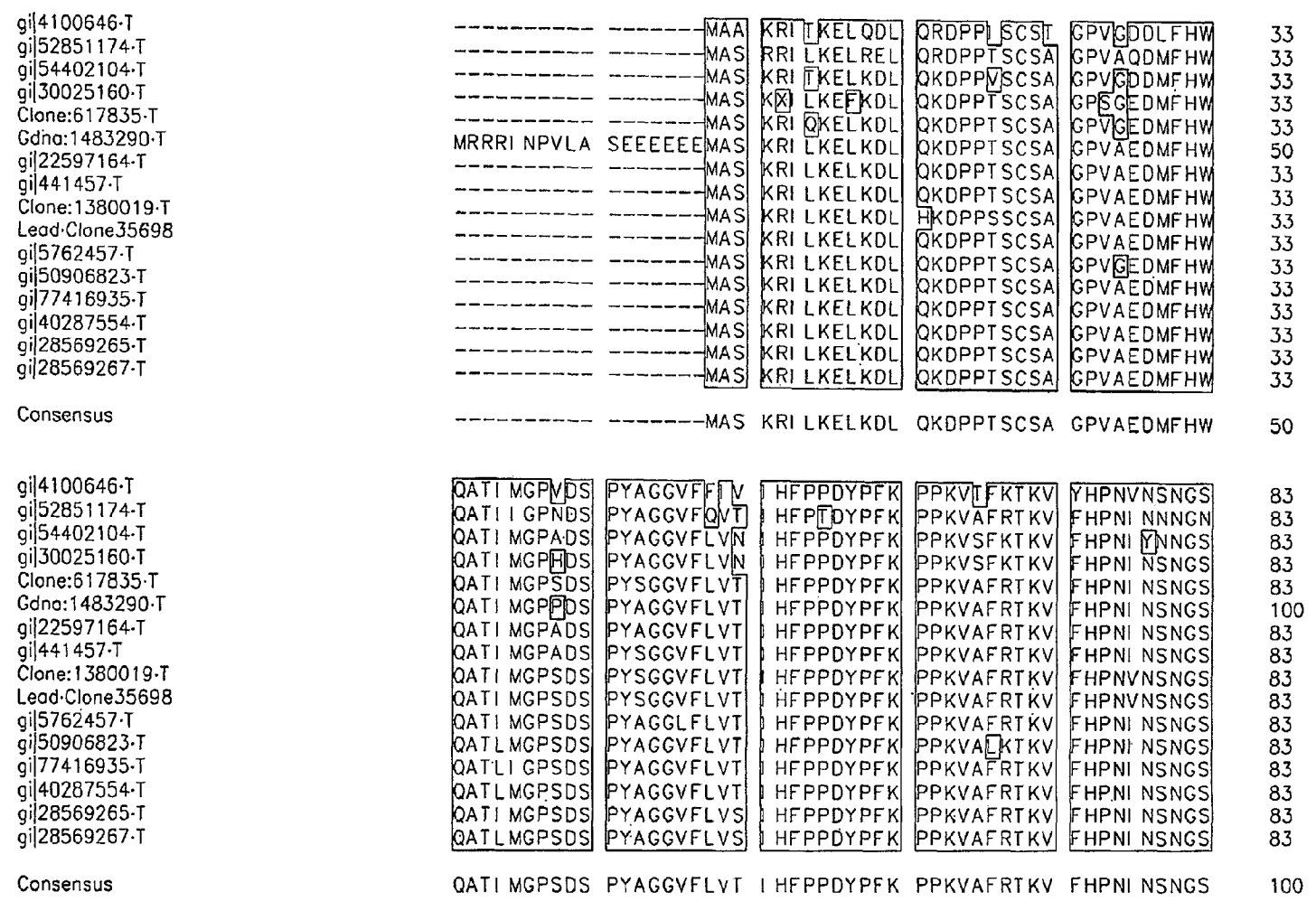

Amino acid sequences of homologs and/or orthologs of the polypeptide having the amino acid sequence set forth in SEQ ID NO:193 are provided in FIG. 9, along with a consensus sequence. A consensus amino acid sequence for such homologs and/or orthologs was determined by aligning amino acid sequences, e.g., amino acid sequences related to SEQ ID NO:193, from a variety of species and determining the most common amino acid or type of amino acid at each position. For example, the alignment in FIG. 9 provides the amino acid sequences of Ceres Clone 35698 (SEQ ID NO:193), Clone 1380019·T (SEQ ID NO:266), gi|441457·T (SEQ ID NO:268), Ceres Annot:1483290·T (SEQ ID NO:270), gi|40287554·T (SEQ ID NO:271), gi|28569265·T (SEQ ID NO:274), gi|22597164·T (SEQ ID NO:278), Clone 617835·T (SEQ ID NO:279), gi|5762457·T (SEQ ID NO:281), gi|77416935·T (SEQ ID NO:284), gi|28569267·T (SEQ ID NO:285), gi|50906823·T (SEQ ID NO:295), gi|30025160·T (SEQ ID NO:315), gi|54402104·T (SEQ ID NO:321), gi|52851174·T (SEQ ID NO:326), and gi|4100646·T (SEQ ID NO:330). Other homologs and/or orthologs include Ceres CLONE ID no. 1346445 (SEQ ID NO:194), Public GI no. 441457 (SEQ ID NO:195), Public GI no. 19347859 (SEQ ID NO:196), Ceres Annot:1483290 (SEQ ID NO:198), Public GI no. 40287554 (SEQ ID NO:199), Public GI no. 21553796 (SEQ ID NO:200), Public GI no. 28569271 (SEQ ID NO:201), Public GI no. 28569265 (SEQ ID NO:202), Public GI no. 66354420 (SEQ ID NO:203), Public GI no. 21280893 (SEQ ID NO:204), Public GI no. 21554343 (SEQ ID NO:205), Public GI no. 22597164 (SEQ ID NO:206), Ceres CLONE ID no. 617835 (SEQ ID NO:207), Public GI no. 30693871 (SEQ ID NO:208), Public GI no. 5762457 (SEQ ID NO:209), Public GI no. 464981 (SEQ ID NO:210), Public GI no. 456568 (SEQ ID NO:211), Public GI no. 77416935 (SEQ ID NO:212), Public GI no. 28569267 (SEQ ID NO:213), Public GI no. 28569261 (SEQ ID NO:214), Ceres CLONE ID no. 39130 (SEQ ID NO:215), Ceres CLONE ID no. 16865 (SEQ ID NO:216), Ceres CLONE ID no. 575067 (SEQ ID NO:217), Ceres Annot: 1467392 (SEQ ID NO:219), Ceres CLONE ID no. 25162 (SEQ ID NO:220), Ceres Annot:1529647 (SEQ ID NO:222), Ceres CLONE ID no. 1405728 (SEQ ID NO:223), Public GI no. 54288726 (SEQ ID NO:224), Public GI no. 50906823 (SEQ ID NO:225), Public GI no. 83306206 (SEQ ID. NO:226), Public GI no. 20152203 (SEQ ID NO:227), Public GI no. 40287568 (SEQ ID NO:228), Public GI no. 50929483 (SEQ ID NO:229), Ceres Annot: 1450556 (SEQ ID NO:231), Ceres CLONE ID no. 1031152 (SEQ ID NO:232), Public GI no. 52548244 (SEQ ID NO:233), Public GI no. 82621144 (SEQ ID NO:234), Ceres CLONE ID no. 878043 (SEQ ID NO:235), Public GI no. 34909292 (SEQ ID NO:236), Public GI no. 2668744 (SEQ ID NO:237), Ceres CLONE ID no. 511132 (SEQ ID NO:238), Ceres Annot:1533930 (SEQ ID NO:240), Ceres Annot:1495171 (SEQ ID NO:242), Public GI no. 20086317 (SEQ ID NO:243), Ceres CLONE ID no. 10022 (SEQ ID NO:244), Ceres CLONE ID no. 12547 (SEQ ID NO:245), Ceres CLONE ID no. 27679 (SEQ ID NO:246), Public GI no. 20259611 (SEQ ID NO:247), Public GI no. 30025160 (SEQ ID NO:248), Public GI no. 50904839 (SEQ ID NO:249), Ceres CLONE ID no. 1063753 (SEQ ID NO:250), Ceres Annot: 1533218 (SEQ ID NO:252), Public GI no. 297880 (SEQ ID NO:253), Ceres CLONE ID no. 1357060 SEQ ID NO:254), Public GI no. 54402104 (SEQ ID NO:255), Public GI no. 50725323 (SEQ ID NO:256), Ceres CLONE ID no. 376667 (SEQ ID NO:257), Ceres CLONE ID no. 256705 (SEQ ID NO:258), Public GI no. 20259629 (SEQ ID NO:259), Public GI no. 52851174 (SEQ ID NO:260), Ceres CLONE ID no. 1061097 (SEQ ID NO:261), Public GI no. 1373001 (SEQ ID NO:262), Public GI no. 66354468 (SEQ ID NO:263), Public GI no. 4100646 (SEQ ID NO:264), Ceres CLONE ID no. 1380019 (SEQ ID NO:265), Ceres CLONE ID no. 1346445_T (SEQ ID NO:267), Public GI no. 19347859_T (SEQ ID NO:269), Public GI no. 21553796_T (SEQ ID NO:272), Public GI no. 28569271_T (SEQ ID NO:273), Public GI no. 66354420_T (SEQ ID NO:275), Public GI no. 21280893_T (SEQ ID NO:276), Public GI no. 21554343_T (SEQ ID NO:277), Public GI no. 30693871_T (SEQ ID NO:280), Public GI no. 464981_T (SEQ ID NO:282), Public GI no. 456568_T (SEQ ID NO:283), Public GI no. 28569261_T (SEQ ID NO:286), Ceres CLONE ID no. 39130_T (SEQ ID NO:287), Ceres CLONE ID no. 16865_T (SEQ ID NO:288), Ceres CLONE ID no. 575067_T (SEQ ID NO:289), Ceres Annot:1467392_T (SEQ ID NO:290), Ceres CLONE ID no. 25162_T (SEQ ID NO:291), Ceres Annot: 1529647_T (SEQ ID NO:292), Ceres CLONE ID no. 1405728_T (SEQ ID NO:293), Public GI no. 54288726_T (SEQ ID NO:294), Public GI no. 83306206_T (SEQ ID NO:296), Public GI no. 20152203_T (SEQ ID NO:297), Public GI no. 40287568_T (SEQ ID NO:298), Public GI no. 50929483_T (SEQ ID NO:299), Ceres Annot:1450556_T (SEQ ID NO:300), Ceres CLONE ID no. 1031152_T (SEQ ID NO:301), Public GI no. 52548244_T (SEQ ID NO:302), Public GI no. 82621144_T (SEQ ID NO:303), Ceres CLONE ID no. 878043_T (SEQ ID NO:304), Public GI no. 34909292_T (SEQ ID NO:305), Public GI no. 2668744_T (SEQ ID NO:306), Ceres CLONE ID no. 511132_T (SEQ ID NO:307), Ceres Annot:1533930_T (SEQ ID NO:308), Ceres Annot:1495171_T (SEQ ID NO:309), Public GI no. 20086317_T (SEQ ID NO:310), Ceres CLONE ID no. 10022_T (SEQ ID NO:311), Ceres CLONE ID no. 12547_T (SEQ ID NO:312), Ceres CLONE ID no. 27679_T (SEQ ID NO:313), Public GI no. 20259611_T (SEQ ID NO:314), Public GI no. 50904839_T (SEQ ID NO:316), Ceres CLONE ID no. 1063753_T (SEQ ID NO:317), Ceres Annot: 1533218_T (SEQ ID NO:318), Public GI no. 297880_T (SEQ ID NO:319), Ceres CLONE ID no. 1357060_T (SEQ ID NO:320), Public GI no. 50725323_T (SEQ ID NO:322), Ceres CLONE ID no. 376667_T (SEQ ID NO:323), Ceres CLONE ID no. 256705_T (SEQ ID NO:324), Public GI no. 20259629_T (SEQ ID NO:325), Ceres CLONE ID no. 1061097_T (SEQ ID NO:327), Public GI no. 1373001_T (SEQ ID NO:328), and Public GI no. 66354468_T (SEQ ID NO:329).

In some cases, an oil-modulating polypeptide includes a polypeptide having at least 80% sequence identity, e.g., 80%, 85%, 90%, 95%, 97%, 98%, or 99% sequence identity, to an amino acid sequence corresponding to SEQ ID NO:194, SEQ ID NO:195, SEQ ID NO:196, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211, SEQ ID NO:212, SEQ ID NO:213, SEQ ID NO:214, SEQ ID NO:215, SEQ ID NO:216, SEQ ID NO:217, SEQ ID NO:219, SEQ ID NO:220, SEQ ID NO:222, SEQ ID NO:223, SEQ ID NO:224, SEQ ID NO:225, SEQ ID NO:226, SEQ ID NO:227, SEQ ID NO:228, SEQ ID NO:229, SEQ ID NO:231, SEQ ID NO:232, SEQ ID NO:233, SEQ ID NO:234, SEQ ID NO:235, SEQ ID NO:236, SEQ ID NO:237, SEQ ID NO:238, SEQ ID NO:240, SEQ ID NO:242, SEQ ID NO:243, SEQ ID NO:244, SEQ ID NO:245, SEQ ID NO:246, SEQ ID NO:247, SEQ ID NO:248, SEQ ID NO:249, SEQ ID NO:250, SEQ ID NO:252, SEQ ID NO:253, SEQ ID NO:254, SEQ ID NO:255, SEQ ID NO:256, SEQ ID NO:257, SEQ ID NO:258, SEQ ID NO:259, SEQ ID NO:260, SEQ ID NO:261, SEQ ID NO:262, SEQ ID NO:263, SEQ ID NO:264, SEQ ID NO:265, SEQ ID NO:266, SEQ ID NO:267, SEQ ID NO:268, SEQ ID NO:269, SEQ ID NO:270, SEQ ID NO:271, SEQ ID NO:272, SEQ ID NO:273, SEQ ID NO:274, SEQ ID NO:275, SEQ ID NO:276, SEQ ID NO:277, SEQ ID NO:278, SEQ ID NO:279, SEQ ID NO:280, SEQ ID NO:281, SEQ ID NO:282, SEQ ID NO:283, SEQ ID NO:284, SEQ ID NO:285, SEQ ID NO:286, SEQ ID NO:287, SEQ ID NO:288, SEQ ID NO:289, SEQ ID NO:290, SEQ ID NO:291, SEQ ID NO:292, SEQ ID NO:293, SEQ ID NO:294, SEQ ID NO:295, SEQ ID NO:296, SEQ ID NO:297, SEQ ID NO:298, SEQ ID NO:299, SEQ ID NO:300, SEQ ID NO:301, SEQ ID NO:302, SEQ ID NO:303, SEQ ID NO:304, SEQ ID NO:305, SEQ ID NO:306, SEQ ID NO:307, SEQ ID NO:308, SEQ ID NO:309, SEQ ID NO:310, SEQ ID NO:311, SEQ ID NO:312, SEQ ID NO:313, SEQ ID NO:314, SEQ ID NO:315, SEQ ID NO:316, SEQ ID NO:317, SEQ ID NO:318, SEQ ID NO:319, SEQ ID NO:320, SEQ ID NO:321, SEQ ID NO:322, SEQ ID NO:323, SEQ ID NO:324, SEQ ID NO:325, SEQ ID NO:326, SEQ ID NO:327, SEQ ID NO:328, SEQ ID NO:329, SEQ ID NO:330, or the consensus sequence set forth in FIG. 9.

SEQ ID NO:332 sets forth the amino acid sequence of another *Arabidopsis* clone, identified herein as Ceres Clone 36412 (SEQ ID NO:331), that is predicted to encode a polypeptide that does not have homology to an existing protein family based on Pfam analysis. An oil-modulating polypeptide can comprise the amino acid sequence set forth in SEQ ID NO:332. Alternatively, an oil-modulating polypeptide can be a variant having at least 45% sequence identity, e.g., 45%, 50%, 55%, 60%, 65%, 70%, 75%, 80%, 85%, 90%, 95%, 97%, 98%, or 99% sequence identity, to the amino acid sequence set forth in SEQ ID NO:332.

Figure 10:
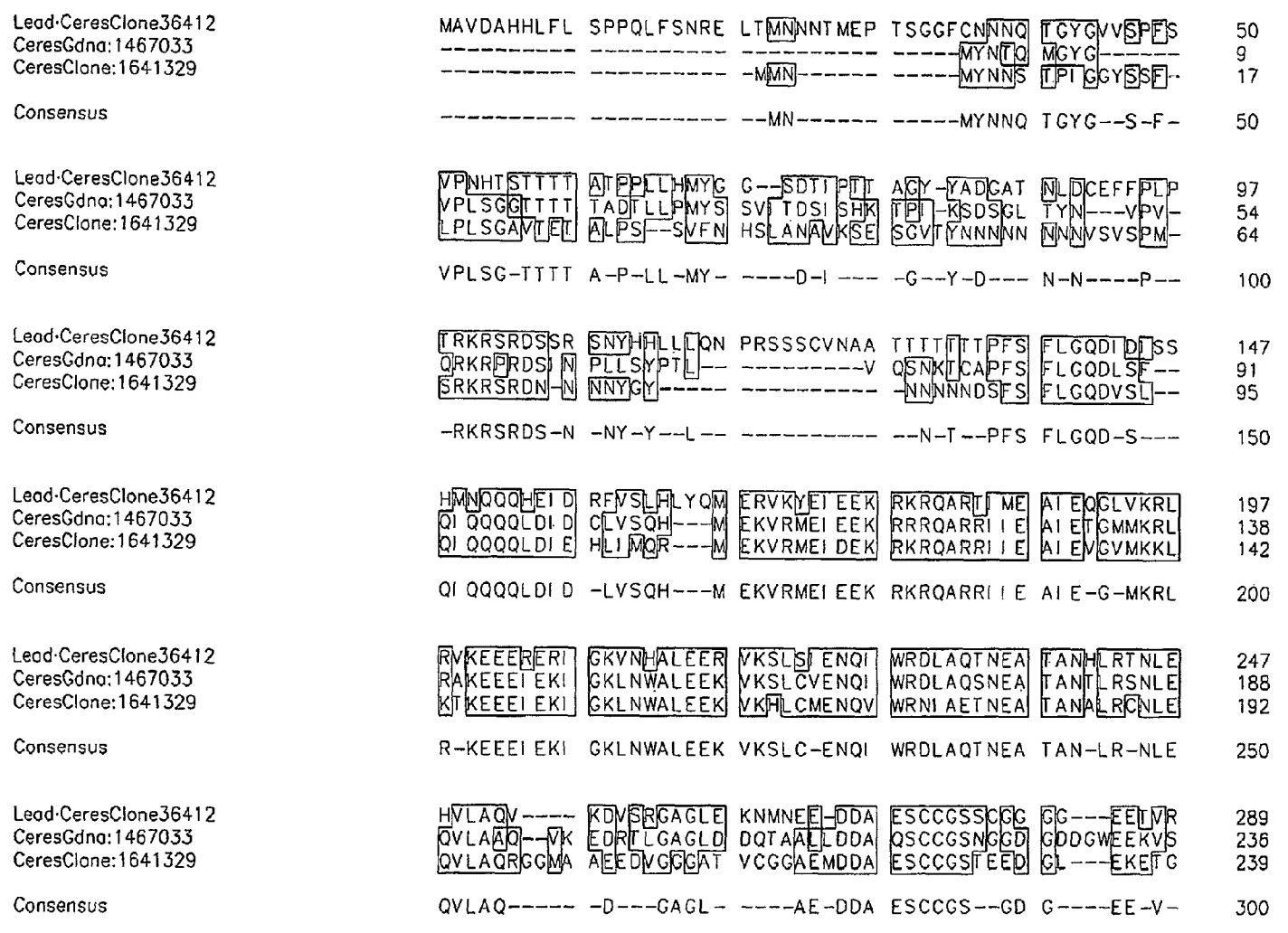

Amino acid sequences of homologs of the polypeptide having the amino acid sequence set forth in SEQ ID NO:332 are provided in FIG. 10, along with a consensus sequence. A consensus amino acid sequence for such homologs was determined by aligning amino acid sequences, e.g., amino acid sequences related to SEQ ID NO:332, from a variety of species and determining the most common amino acid or type of amino acid at each position. For example, the alignment in FIG. 10 provides the amino acid sequences of Ceres Clone 36412 (SEQ ID NO:332), Ceres Annot:1467033 (SEQ ID NO:335) and Ceres Clone:1641329 (SEQ ID NO:338). Other homologs include Public GI no. 3152583 (SEQ ID NO:333), Ceres Annot:1536919 (SEQ ID NO:337), Ceres CLONE ID no. 1650419 (SEQ ID NO:339), and Ceres CLONE ID no. 597699 (SEQ ID NO:340).

In some cases, an oil-modulating polypeptide includes a polypeptide having at least 80% sequence identity, e.g., 80%, 85%, 90%, 95%, 97%, 98%, or 99% sequence identity, to an amino acid sequence corresponding to SEQ ID NO:333, SEQ ID NO:335, SEQ ID NO:337, SEQ ID NO:338, SEQ ID NO:339, SEQ ID NO:340, or the consensus sequence set forth in FIG. 10.

SEQ ID NO:342 sets forth the amino acid sequence of another *Arabidopsis* clone, identified herein as Ceres Clone 368 (SEQ ID NO:341), that is predicted to encode a polypeptide that does not have homology to an existing protein family based on Pfam analysis. An oil-modulating polypeptide can comprise the amino acid sequence set forth in SEQ ID NO:342. Alternatively, an oil-modulating polypeptide can be a homolog having at least 40% sequence identity, e.g., 40%, 45%, 50%, 55%, 60%, 65%, 70%, 75%, 80%, 85%, 90%, 95%, 97%, 98%, or 99% sequence identity, to the amino acid sequence set forth in SEQ ID NO:342

An oil-modulating polypeptide can be a cytochrome p450 polypeptide. Cytochrome p450 enzymes are haem-thiolate polypeptides involved in the oxidative modification of various compounds. SEQ ID NO:344 sets forth the amino acid sequence of an *Arabidopsis* clone, identified herein as Ceres Clone 41046 (SEQ ID NO:343), that is predicted to encode a cytochrome p450 enzyme. An oil-modulating polypeptide can comprise the amino acid sequence set forth in SEQ ID NO:344. Alternatively, an oil-modulating polypeptide can be a homolog, ortholog, or variant of the polypeptide having the amino acid sequence set forth in SEQ ID NO:344. For example, an oil-modulating polypeptide can have an amino acid sequence with at least 40% sequence identity, e.g., 40%, 45%, 50%, 55%, 60%, 65%, 70%, 75%, 80%, 85%, 90%, 95%, 97%, 98%, or 99% sequence identity, to the amino acid sequence set forth in SEQ ID NO:344.

An oil-modulating polypeptide can have a DUF662 domain characteristic of a family of hypothetical eukaryotic proteins. SEQ ID NO:346 sets forth the amino acid sequence of an *Arabidopsis* clone, identified herein as Ceres Clone 4829 (SEQ ID NO:345), that is predicted to encode a eukaryotic polypeptide. An oil-modulating polypeptide can comprise the amino acid sequence set forth in SEQ ID NO:346. Alternatively, an oil-modulating polypeptide can be a homolog, ortholog, or variant of the polypeptide having the amino acid sequence set forth in SEQ ID NO:346. For example, an oil-modulating polypeptide can have an amino acid sequence with at least 50% sequence identity, e.g., 50%, 55%, 60%, 65%, 70%, 75%, 80%, 85%, 90%, 95%, 97%, 98%, or 99% sequence identity, to the amino acid sequence set forth in SEQ ID NO:346.

Amino acid sequences of homologs and/or orthologs of the polypeptide having the amino acid sequence set forth in SEQ ID NO:346 are provided in FIG. 11, along with a consensus sequence. A consensus amino acid sequence for such homologs and/or orthologs was determined by aligning amino acid sequences, e.g., amino acid sequences related to SEQ ID NO:346, from a variety of species and determining the most common amino acid or type of amino acid at each position. For example, the alignment in FIG. 11 provides the amino acid sequences of Ceres Clone 4829 (SEQ ID NO:346), Ceres Annot:1485102 (SEQ ID NO:350), Ceres Clone:1646533 (SEQ ID NO:351), gi|29371519 (SEQ ID NO:352), gi|45935148 (SEQ ID NO:354), Ceres Clone:359934 (SEQ ID NO:355), and Ceres Clone:839270 (SEQ ID NO:357). Other homologs and/or orthologs include Ceres CLONE ID no. 24885 (SEQ ID NO:347), Ceres CLONE ID no. 27878 (SEQ ID NO:348), Public GI no. 38347602 (SEQ ID NO:353), Ceres CLONE ID no. 294598 (SEQ ID NO:356), Ceres Clone:1836904 (SEQ ID NO:525), Ceres Clone:1932013 (SEQ ID NO:526), and Ceres Clone:1768109 (SEQ ID NO:527).

In some cases, an oil-modulating polypeptide includes a polypeptide having at least 80% sequence identity, e.g., 80%, 85%, 90%, 95%, 97%, 98%, or 99% sequence identity, to an amino acid sequence corresponding to SEQ ID NO:347, SEQ ID NO:348, SEQ ID NO:350, SEQ ID NO:351, SEQ ID NO:352, SEQ ID NO:353, SEQ ID NO:354, SEQ ID NO:355, SEQ ID NO:356, SEQ ID NO:357, SEQ ID NO:525, SEQ ID NO:526, SEQ ID NO:527, or the consensus sequence set forth in FIG. 11.

An oil-modulating polypeptide can be a ribosomal protein L28e. Ribosomal protein L28e forms part of the 60S ribosomal subunit. SEQ ID NO:359 sets forth the amino acid sequence of an *Arabidopsis* clone, identified herein as Ceres Clone 5426 (SEQ ID NO:358), that is predicted to encode a ribosomal protein L28e. An oil-modulating polypeptide can comprise the amino acid sequence set forth in SEQ ID NO:359. Alternatively, an oil-modulating polypeptide can be a homolog, ortholog, or variant of the polypeptide having the amino acid sequence set forth in SEQ ID NO:359. For example, an oil-modulating polypeptide can have an amino acid sequence with at least 65% sequence identity, e.g., 65%, 70%, 75%, 80%, 85%, 90%, 95%, 97%, 98%, or 99% sequence identity, to the amino acid sequence set forth in SEQ ID NO:359.

Amino acid sequences of homologs and/or orthologs of the polypeptide having the amino acid sequence set forth in SEQ ID NO:359 are provided in FIG. 12, along with a consensus sequence. A consensus amino acid sequence for such homologs and/or orthologs was determined by aligning amino acid sequences, e.g., amino acid sequences related to SEQ ID NO:359, from a variety of species and determining the most common amino acid or type of amino acid at each position. For example, the alignment in FIG. 12 provides the amino acid sequences of Ceres Clone 5426 (SEQ ID NO:359), Ceres Clone:1123542 (SEQ ID NO:360), Ceres Annot:1499194 (SEQ ID NO:368), and Ceres Clone:557065 (SEQ ID NO:371). Other homologs and/or orthologs include Ceres CLONE ID no. 9083 (SEQ ID NO:361), Public GI no. 79322493 (SEQ ID NO:362), Ceres CLONE ID no. 265408 (SEQ ID NO:363), Ceres CLONE ID no. 32164 (SEQ ID NO:364), Ceres CLONE ID no. 1068047 (SEQ ID NO:365), Ceres CLONE ID no. 965035 (SEQ ID NO:366), Ceres Annot:1439584 (SEQ ID NO:370), Ceres CLONE ID no. 465060 (SEQ ID NO:372), Ceres Clone:1458107 (SEQ ID NO:512), Ceres Clone:1932511 (SEQ ID NO:513), Ceres Clone:1850967 (SEQ ID NO:514), Ceres Clone:1835707 (SEQ ID NO:515), Ceres Clone:1727213 (SEQ ID NO:516), Ceres Clone:1767577 (SEQ ID NO:517), Ceres Clone:1712104 (SEQ ID NO:518), Ceres Clone:1778377 (SEQ ID NO:519), gi|76573317 (SEQ ID NO:520), Ceres Clone:1787980 (SEQ ID NO:521), gi|115465181 (SEQ ID NO:522), gi|48716267 (SEQ ID NO:523), and Ceres Clone:575833 (SEQ ID NO:524).

In some cases, an oil-modulating polypeptide includes a polypeptide having at least 80% sequence identity, e.g., 80%, 85%, 90%, 95%, 97%, 98%, or 99% sequence identity, to an amino acid sequence corresponding to SEQ ID NO:360, SEQ ID NO:361, SEQ ID NO:362, SEQ ID NO:363, SEQ ID NO:364, SEQ ID NO:365, SEQ ID NO:366, SEQ ID NO:368, SEQ ID NO:370, SEQ ID NO:371, SEQ ID NO:372, SEQ ID NO:512, SEQ ID NO:513, SEQ ID NO:514, SEQ ID NO:515, SEQ ID NO:516, SEQ ID NO:517, SEQ ID NO:518, SEQ ID NO:519, SEQ ID NO:520, SEQ ID NO:521, SEQ ID NO:522, SEQ ID NO:523, SEQ ID NO:524, or the consensus sequence set forth in FIG. 12.

An oil-modulating polypeptide can be a Major Facilitator Superfamily (MFS) transporter. MFS transporters are single-polypeptide secondary carriers capable of transporting small solutes in response to chemiosmotic ion gradients. SEQ ID NO:374 sets forth the amino acid sequence of an *Arabidopsis* clone, identified herein as Ceres Clone 7894 (SEQ ID NO:373), that is predicted to encode an MFS transporter polypeptide. The MFS family of proteins is characterized by the presence of 12 membrane-spanning domains and a conserved MFS-specific motif between membrane-spanning domains 2 and 3. Members of the MFS protein family have been further classified into a number of sub-families. An oil-modulating polypeptide can comprise the amino acid sequence set forth in SEQ ID NO:374. Alternatively, an oil-modulating polypeptide can be a homolog, ortholog, or variant of the polypeptide having the amino acid sequence set forth in SEQ ID NO:374. For example, an oil-modulating polypeptide can have an amino acid sequence with at least 60% sequence identity, e.g., 60%, 65%, 70%, 75%, 80%, 85%, 90%, 95%, 97%, 98%, or 99% sequence identity, to the amino acid sequence set forth in SEQ ID NO:374. Such oil-modulating polypeptides may have a domain that is a sub-family of MFS transporter polypeptides.

Figure 13:
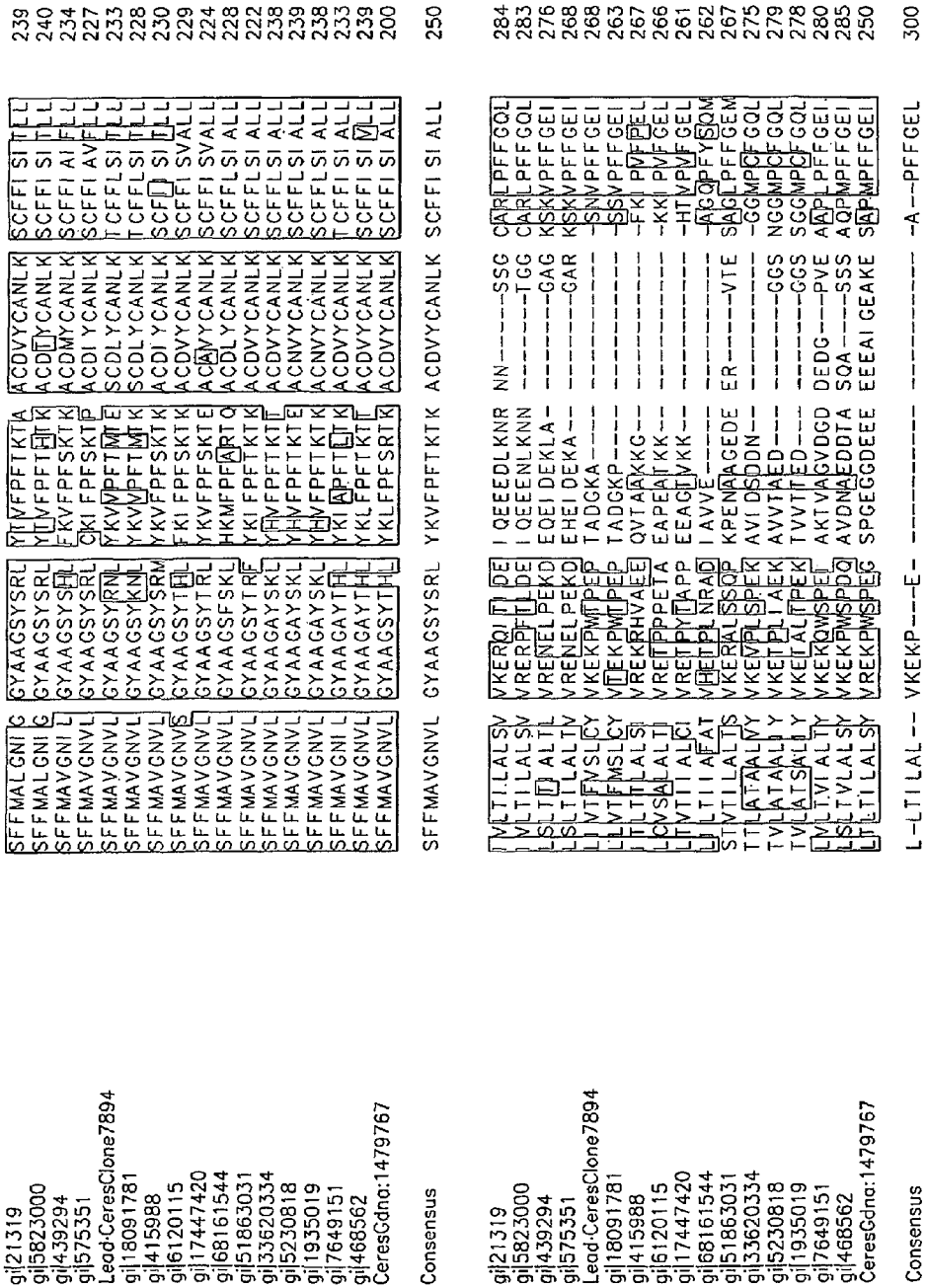
FIG. 13 is an alignment of Ceres Clone 7894 (SEQ ID NO:374) with homologous and/or orthologous amino acid sequences gi|18091781 (SEQ ID NO:375), gi|468562 (SEQ ID NO:376), Ceres Annot:1479767 (SEQ ID NO:378), gi|7649151 (SEQ ID NO:379), gi|33620334 (SEQ ID NO:382), gi|439294 (SEQ ID NO:383), gi|5230818 (SEQ ID NO:385), gi|17447420 (SEQ ID NO:386), gi|1935019 (SEQ ID NO:387), gi|51863031 (SEQ ID NO:388), gi|575351 (SEQ ID NO:389), gi|68161544 (SEQ ID NO:390), gi|21319 (SEQ ID NO:392), gi|5823000 (SEQ ID NO:393), gi|6120115 (SEQ ID NO:395), and gi|415988 (SEQ ID NO:396).

Amino acid sequences of homologs and/or orthologs of the polypeptide having the amino acid sequence set forth in SEQ ID NO:374 are provided in FIG. 13, along with a consensus sequence. A consensus amino acid sequence for such homologs and/or orthologs was determined by aligning amino acid sequences, e.g., amino acid sequences related to SEQ ID NO:374, from a variety of species and determining the most common amino acid or type of amino acid at each position. For example, the alignment in FIG. 13 provides the amino acid sequences of Ceres Clone 7894 (SEQ ID NO:374), gi|18091781 (SEQ ID NO:375), gi|468562 (SEQ ID NO:376), Ceres Annot:1479767 (SEQ ID NO:378), gi|7649151 (SEQ ID NO:379), gi|33620334 (SEQ ID NO:382), gi|439294 (SEQ ID NO:383), gi|5230818 (SEQ ID NO:385), gi|17447420 (SEQ ID NO:386), gi|1935019 (SEQ ID NO:387), gi|51863031 (SEQ ID NO:388), gi|575351 (SEQ ID NO:389), gi|68161544 (SEQ ID NO:390), gi|21319 (SEQ ID NO:392), gi|5823000 (SEQ ID NO:393), gi|6120115 (SEQ ID NO:395), and gi|415988 (SEQ ID NO:396). Other homologs and/or orthologs include Ceres Annot:1486712 (SEQ ID NO:381), Public GI no. 77153413 (SEQ ID NO:384), Public GI no. 6434833 (SEQ ID NO:391), Public GI no. 633172 (SEQ ID NO:394), gi|116008246 (SEQ ID NO:528), and Ceres Clone:1925996 (SEQ ID NO:529).

In some cases, an oil-modulating polypeptide includes a polypeptide having at least 80% sequence identity, e.g., 80%, 85%, 90%, 95%, 97%, 98%, or 99% sequence identity, to an amino acid sequence corresponding to SEQ ID NO:375, SEQ ID NO:376, SEQ ID NO:378, SEQ ID NO:379, SEQ ID NO:381, SEQ ID NO:382, SEQ ID NO:383, SEQ ID NO:384, SEQ ID NO:385, SEQ ID NO:386, SEQ ID NO:387, SEQ ID NO:388, SEQ ID NO:389, SEQ ID NO:390, SEQ ID NO:391, SEQ ID NO:392, SEQ ID NO:393, SEQ ID NO:394, SEQ ID NO:395, SEQ ID NO:396, SEQ ID NO:528, SEQ ID NO:529, or the consensus sequence set forth in FIG. 13.

SEQ ID NO:398 sets forth the amino acid sequence of another *Arabidopsis* clone, identified herein as Ceres Clone 8161 (SEQ ID NO:397), that is predicted to encode a polypeptide that does not have homology to an existing protein family based on Pfam analysis. An oil-modulating polypeptide can comprise the amino acid sequence set forth in SEQ ID NO:398. Alternatively, an oil-modulating polypeptide can be a homolog having at least 40% sequence identity, e.g., 40%, 45%, 50%, 55%, 60%, 65%, 70%, 75%, 80%, 85%, 90%, 95%, 97%, 98%, or 99% sequence identity, to the amino acid sequence set forth in SEQ ID NO:398.

An oil-modulating polypeptide encoded by a recombinant nucleic acid can be a native oil-modulating polypeptide, i.e., one or more additional copies of the coding sequence for an oil-modulating polypeptide that is naturally present in the cell. Alternatively, an oil-modulating polypeptide can be heterologous to the cell, e.g., a transgenic *Lycopersicon* plant can contain the coding sequence for a transporter polypeptide from a *Glycine* plant.

An oil-modulating polypeptide can include additional amino acids that are not involved in oil modulation, and thus can be longer than would otherwise be the case. For example, an oil-modulating polypeptide can include an amino acid sequence that functions as a reporter. Such an oil-modulating polypeptide can be a fusion protein in which a green fluorescent protein (GFP) polypeptide is fused to, e.g., SEQ ID NO:136, or in which a yellow fluorescent protein (YFP) polypeptide is fused to, e.g., SEQ ID NO:81. In some embodiments, an oil-modulating polypeptide includes a purification tag, a chloroplast transit peptide, a mitochondrial transit peptide, or a leader sequence added to the amino or carboxy terminus.

Oil-modulating polypeptide candidates suitable for use in the invention can be identified by analysis of nucleotide and polypeptide sequence alignments. For example, performing a query on a database of nucleotide or polypeptide sequences can identify homologs and/or orthologs of oil-modulating polypeptides. Sequence analysis can involve BLAST, Reciprocal BLAST, or PSI-BLAST analysis of nonredundant databases using known oil-modulating polypeptide amino acid sequences. Those polypeptides in the database that have greater than 40% sequence identity can be identified as candidates for further evaluation for suitability as an oil-modulating polypeptide. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains suspected of being present in oil-modulating polypeptides, e.g., conserved functional domains.

The identification of conserved regions in a template or subject polypeptide can facilitate production of variants of wild type oil-modulating polypeptides. Conserved regions can be identified by locating a region within the primary amino acid sequence of a template polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/ and pfam.janelia.org/. A description of the information included at the Pfam database is described in Sonnhammer et al., *Nucl. Acids Res.*, 26:320-322 (1998); Sonnhammer et al., *Proteins,* 28:405-420 (1997); and Bateman et al., *Nucl. Acids Res.*, 27:260-262 (1999).

Conserved regions also can be determined by aligning sequences of the same or related polypeptides from closely related species. Closely related species preferably are from the same family. In some embodiments, alignment of sequences from two different species is adequate. For example, sequences from *Arabidopsis* and *Zea mays* can be used to identify one or more conserved regions.

Typically, polypeptides that exhibit at least about 40% amino acid sequence identity are useful to identify conserved regions. Conserved regions of related polypeptides can exhibit at least 45% amino acid sequence identity (e.g., at least 50%, at least 60%, at least 70%, at least 80%, or at least 90% amino acid sequence identity). In some embodiments, a conserved region of target and template polypeptides exhibit at least 92%, 94%, 96%, 98%, or 99% amino acid sequence identity. Amino acid sequence identity can be deduced from amino acid or nucleotide sequences. In certain cases, highly conserved domains have been identified within oil-modulating polypeptides. These conserved regions can be useful in identifying functionally similar (orthologous) oil-modulating polypeptides.

In some instances, suitable oil-modulating polypeptides can be synthesized on the basis of consensus functional domains and/or conserved regions in polypeptides that are homologous oil-modulating polypeptides. Domains are groups of substantially contiguous amino acids in a polypeptide that can be used to characterize protein families and/or parts of proteins. Such domains have a "fingerprint" or "signature" that can comprise conserved (1) primary sequence, (2) secondary structure, and/or (3) three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

Representative homologs and/or orthologs of oil-modulating polypeptides are shown in FIGS. 1-13. Each Figure represents an alignment of the amino acid sequence of an oil-modulating polypeptide with the amino acid sequences of corresponding homologs and/or orthologs. Amino acid sequences of oil-modulating polypeptides and their corresponding homologs and/or orthologs have been aligned to identify conserved amino acids and to determine consensus sequences that contain frequently occurring amino acid residues at particular positions in the aligned sequences, as shown in FIGS. 1-13. A dash in an aligned sequence represents a gap, i.e., a lack of an amino acid at that position. Identical amino acids or conserved amino acid substitutions among aligned sequences are identified by boxes.

Each consensus sequence is comprised of conserved regions. Each conserved region contains a sequence of contiguous amino acid residues. A dash in a consensus sequence indicates that the consensus sequence either lacks an amino acid at that position or includes an amino acid at that position. If an amino acid is present, the residue at that position corresponds to one found in any aligned sequence at that position.

Useful polypeptides can be constructed based on the consensus sequence in FIG. 1, FIG. 2, FIG. 3, FIG. 4, FIG. 5, FIG. 6, FIG. 7, FIG. 8, FIG. 9, FIG. 10, FIG. 11, FIG. 12, or FIG. 13. Such a polypeptide includes the conserved regions in the selected consensus sequence, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at all positions marked by dashes, such a polypeptide has a length that is the sum of the amino acid residues in all conserved regions and all dashes.

Consensus domains and conserved regions can be identified by homologous polypeptide sequence analysis as described above. The suitability of polypeptides for use as oil-modulating polypeptides can be evaluated by functional complementation studies.

Nucleic Acids

Isolated nucleic acids are provided herein. The terms "nucleic acid" and "polynucleotide" are used interchangeably herein, and refer to both RNA and DNA, including cDNA, genomic DNA, synthetic DNA, and DNA (or RNA) containing nucleic acid analogs. Polynucleotides can have any three-dimensional structure. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, plasmids, vectors, isolated DNA of any sequence, isolated RNA of any sequence, nucleic acid probes, and primers, as well as nucleic acid analogs.

Nucleic acids described herein include oil-modulating nucleic acids. Oil-modulating nucleic acids can be effective to modulate protein levels when transcribed in a plant or plant cell. A oil-modulating nucleic acid can comprise the nucleotide sequence set forth in SEQ ID NO:80, SEQ ID NO:93, SEQ ID NO:95, SEQ ID NO:108, SEQ ID NO:110, SEQ ID NO:117, SEQ ID NO:135, SEQ ID NO:141, SEQ ID NO:143, SEQ ID NO:145, SEQ ID NO:148, SEQ ID NO:151, SEQ ID NO:153, SEQ ID NO:155, SEQ ID NO:158, SEQ ID NO:170, SEQ ID NO:173, SEQ ID NO:175, SEQ ID NO:177, SEQ ID NO:180, SEQ ID NO:183, SEQ ID NO:192, SEQ ID NO:197, SEQ ID NO:218, SEQ ID NO:221, SEQ ID NO:230, SEQ ID NO:239, SEQ ID NO:241, SEQ ID NO:251, SEQ ID NO:331, SEQ ID NO:334, SEQ ID NO:336, SEQ ID NO:341, SEQ ID NO:343, SEQ ID NO:345, SEQ ID NO:349, SEQ ID NO:358, SEQ ID NO:367, SEQ ID NO:369, SEQ ID NO:373, SEQ ID NO:377, SEQ ID NO:380, SEQ ID NO:397, SEQ ID NO:399, SEQ ID NO:400, SEQ ID NO:401, SEQ ID NO:402, SEQ ID NO:403, SEQ ID NO:404, SEQ ID NO:405, SEQ ID NO:406, SEQ ID NO:407, SEQ ID NO:408, SEQ ID NO:409, SEQ ID NO:410, SEQ ID NO:411, SEQ ID NO:412, SEQ ID NO:413, SEQ ID NO:414, SEQ ID NO:415, SEQ ID NO:416, SEQ ID NO:417, SEQ ID NO:418, SEQ ID NO:419, SEQ ID NO:420, SEQ ID NO:421, SEQ ID NO:422, SEQ ID NO:423, SEQ ID NO:424, SEQ ID NO:425, SEQ ID NO:426, SEQ ID NO:427, SEQ ID NO:428, SEQ ID NO:429, SEQ ID NO:430, SEQ ID NO:431, SEQ ID NO:432, SEQ ID NO:433, SEQ ID NO:434, SEQ ID NO:435, SEQ ID NO:436, SEQ ID NO:437, SEQ ID NO:438, SEQ ID NO:439, SEQ ID NO:440, SEQ ID NO:441, SEQ ID NO:442, SEQ ID NO:443, SEQ ID NO:444, SEQ ID NO:445, SEQ ID NO:446, SEQ ID NO:447, SEQ ID NO:448, SEQ ID NO:449, SEQ ID NO:450, SEQ ID NO:451, SEQ ID NO:452, SEQ ID NO:453, SEQ ID NO:454, SEQ ID NO:455, SEQ ID NO:456, SEQ ID NO:457, SEQ ID NO:458, SEQ ID NO:459, SEQ ID NO:460, SEQ ID NO:461, SEQ ID NO:462, SEQ ID NO:463, SEQ ID NO:464, SEQ ID NO:465, SEQ ID NO:466, SEQ ID NO:467, SEQ ID NO:468, SEQ ID NO:469, SEQ ID NO:470, SEQ ID NO:471, SEQ ID NO:472, SEQ ID NO:473, SEQ ID NO:474, SEQ ID NO:475, SEQ ID NO:476, SEQ ID NO:477, SEQ ID NO:478, SEQ ID NO:479, SEQ ID NO:480, SEQ ID NO:481, SEQ ID NO:482, SEQ ID NO:483, SEQ ID NO:484, SEQ ID NO:485, SEQ ID NO:486, SEQ ID NO:487, SEQ ID NO:488, SEQ ID NO:489, SEQ ID NO:490, SEQ ID NO:491, SEQ ID NO:492, SEQ ID NO:493, SEQ ID NO:494, SEQ ID NO:495, SEQ ID NO:496, SEQ ID NO:497, SEQ ID NO:498, SEQ ID NO:499, SEQ ID NO:500, SEQ ID NO:501, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, or SEQ ID NO:575. Alternatively, a oil-modulating nucleic acid can be a variant of the nucleic acid having the nucleotide sequence set forth in SEQ ID NO:80, SEQ ID NO:93, SEQ ID NO:95, SEQ ID NO:108, SEQ ID NO:110, SEQ ID NO:117, SEQ ID NO:135, SEQ ID NO:141, SEQ ID NO:143, SEQ ID NO:145, SEQ ID NO:148, SEQ ID NO:151, SEQ ID NO:153, SEQ ID NO:155, SEQ ID NO:158, SEQ ID NO:170, SEQ ID NO:173, SEQ ID NO:175, SEQ ID NO:177, SEQ ID NO:180, SEQ ID NO:183, SEQ ID NO:192, SEQ ID NO:197, SEQ ID NO:218, SEQ ID NO:221, SEQ ID NO:230, SEQ ID NO:239, SEQ ID NO:241, SEQ ID NO:251, SEQ ID NO:331, SEQ ID NO:334, SEQ ID NO:336, SEQ ID NO:341, SEQ ID NO:343, SEQ ID NO:345, SEQ ID NO:349, SEQ ID NO:358, SEQ ID NO:367, SEQ ID NO:369, SEQ ID NO:373, SEQ ID NO:377, SEQ ID NO:380, SEQ ID NO:397, SEQ ID NO:399, SEQ ID NO:400, SEQ ID NO:401, SEQ ID NO:402, SEQ ID NO:403, SEQ ID NO:404, SEQ ID NO:405, SEQ ID NO:406, SEQ ID NO:407, SEQ ID NO:408, SEQ ID NO:409, SEQ ID NO:410, SEQ ID NO:411, SEQ ID NO:412, SEQ ID NO:413, SEQ ID NO:414, SEQ ID NO:415, SEQ ID NO:416, SEQ ID NO:417, SEQ ID NO:418, SEQ ID NO:419, SEQ ID NO:420, SEQ ID NO:421, SEQ ID NO:422, SEQ ID NO:423, SEQ ID NO:424, SEQ ID NO:425, SEQ ID NO:426, SEQ ID NO:427, SEQ ID NO:428, SEQ ID NO:429, SEQ ID NO:430, SEQ ID NO:431, SEQ ID NO:432, SEQ ID NO:433, SEQ ID NO:434, SEQ ID NO:435, SEQ ID NO:436, SEQ ID NO:437, SEQ ID NO:438, SEQ ID NO:439, SEQ ID NO:440, SEQ ID NO:441, SEQ ID NO:442, SEQ ID NO:443, SEQ ID NO:444, SEQ ID NO:445, SEQ ID NO:446, SEQ ID NO:447, SEQ ID NO:448, SEQ ID NO:449, SEQ ID NO:450, SEQ ID NO:451, SEQ ID NO:452, SEQ ID NO:453, SEQ ID NO:454, SEQ ID NO:455, SEQ ID NO:456, SEQ ID NO:457, SEQ ID NO:458, SEQ ID NO:459, SEQ ID NO:460, SEQ ID NO:461, SEQ ID NO:462, SEQ ID NO:463, SEQ ID NO:464, SEQ ID NO:465, SEQ ID NO:466, SEQ ID NO:467, SEQ ID NO:468, SEQ ID NO:469, SEQ ID NO:470, SEQ ID NO:471, SEQ ID NO:472, SEQ ID NO:473, SEQ ID NO:474, SEQ ID NO:475, SEQ ID NO:476, SEQ ID NO:477, SEQ ID NO:478, SEQ ID NO:479, SEQ ID NO:480, SEQ ID NO:481, SEQ ID NO:482, SEQ ID NO:483, SEQ ID NO:484, SEQ ID NO:485, SEQ ID NO:486, SEQ ID NO:487, SEQ ID NO:488, SEQ ID NO:489, SEQ ID NO:490, SEQ ID NO:491, SEQ ID NO:492, SEQ ID NO:493, SEQ ID NO:494, SEQ ID NO:495, SEQ ID NO:496, SEQ ID NO:497, SEQ ID NO:498, SEQ ID NO:499, SEQ ID NO:500, SEQ ID NO:501, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, or SEQ ID NO:575. For example, a oil-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:80, SEQ ID NO:93, SEQ ID NO:95, SEQ ID NO:108, SEQ ID NO:110, SEQ ID NO:117, SEQ ID NO:135, SEQ ID NO:141, SEQ ID NO:143, SEQ ID NO:145, SEQ ID NO:148, SEQ ID NO:151, SEQ ID NO:153, SEQ ID NO:155, SEQ ID NO:158, SEQ ID NO:170, SEQ ID NO:173, SEQ ID NO:175, SEQ ID NO:177, SEQ ID NO:180, SEQ ID NO:183, SEQ ID NO:192, SEQ ID NO:197, SEQ ID NO:218, SEQ ID NO:221, SEQ ID NO:230, SEQ ID NO:239, SEQ ID NO:241, SEQ ID NO:251, SEQ ID NO:331, SEQ ID NO:334, SEQ ID NO:336, SEQ ID NO:341, SEQ ID NO:343, SEQ ID NO:345, SEQ ID NO:349, SEQ ID NO:358, SEQ ID NO:367, SEQ ID NO:369, SEQ ID NO:373, SEQ ID NO:377, SEQ ID NO:380, SEQ ID NO:397, SEQ ID NO:399, SEQ ID NO:400, SEQ ID NO:401, SEQ ID NO:402, SEQ ID NO:403, SEQ ID NO:404, SEQ ID NO:405, SEQ ID NO:406, SEQ ID NO:407, SEQ ID NO:408, SEQ ID NO:409, SEQ ID NO:410, SEQ ID NO:411, SEQ ID NO:412, SEQ ID NO:413, SEQ ID NO:414, SEQ ID NO:415, SEQ ID NO:416, SEQ ID NO:417, SEQ ID NO:418, SEQ ID NO:419, SEQ ID NO:420, SEQ ID NO:421, SEQ ID NO:422, SEQ ID NO:423, SEQ ID NO:424, SEQ ID NO:425, SEQ ID NO:426, SEQ ID NO:427, SEQ ID NO:428, SEQ ID NO:429, SEQ ID NO:430, SEQ ID NO:431, SEQ ID NO:432, SEQ ID NO:433, SEQ ID NO:434, SEQ ID NO:435, SEQ ID NO:436, SEQ ID NO:437, SEQ ID NO:438, SEQ ID NO:439, SEQ ID NO:440, SEQ ID NO:441, SEQ ID NO:442, SEQ ID NO:443, SEQ ID NO:444, SEQ ID NO:445, SEQ ID NO:446, SEQ ID NO:447, SEQ ID NO:448, SEQ ID NO:449, SEQ ID NO:450, SEQ ID NO:451, SEQ ID NO:452, SEQ ID NO:453, SEQ ID NO:454, SEQ ID NO:455, SEQ ID NO:456, SEQ ID NO:457, SEQ ID NO:458, SEQ ID NO:459, SEQ ID NO:460, SEQ ID NO:461, SEQ ID NO:462, SEQ ID NO:463, SEQ ID NO:464, SEQ ID NO:465, SEQ ID NO:466, SEQ ID NO:467, SEQ ID NO:468, SEQ ID NO:469, SEQ ID NO:470, SEQ ID NO:471, SEQ ID NO:472, SEQ ID NO:473, SEQ ID NO:474, SEQ ID NO:475, SEQ ID NO:476, SEQ ID NO:477, SEQ ID NO:478, SEQ ID NO:479, SEQ ID NO:480, SEQ ID NO:481, SEQ ID NO:482, SEQ ID NO:483, SEQ ID NO:484, SEQ ID NO:485, SEQ ID NO:486, SEQ ID NO:487, SEQ ID NO:488, SEQ ID NO:489, SEQ ID NO:490, SEQ ID NO:491, SEQ ID NO:492, SEQ ID NO:493, SEQ ID NO:494, SEQ ID NO:495, SEQ ID NO:496, SEQ ID NO:497, SEQ ID NO:498, SEQ ID NO:499, SEQ ID NO:500, SEQ ID NO:501, SEQ ID NO:546, SEQ ID NO:547, SEQ ID NO:548, SEQ ID NO:549, SEQ ID NO:550, SEQ ID NO:551, SEQ ID NO:552, SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, SEQ ID NO:562, SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, SEQ ID NO:572, SEQ ID NO:573, SEQ ID NO:574, or SEQ ID NO:575.

An "isolated nucleic acid" can be, for example, a naturally-occurring DNA molecule, provided one of the nucleic acid sequences normally found immediately flanking that DNA molecule in a naturally-occurring genome is removed or absent. Thus, an isolated nucleic acid includes, without limitation, a DNA molecule that exists as a separate molecule, independent of other sequences (e.g., a chemically synthesized nucleic acid, or a cDNA or genomic DNA fragment produced by the polymerase chain reaction (PCR) or restriction endonuclease treatment). An isolated nucleic acid also refers to a DNA molecule that is incorporated into a vector, an autonomously replicating plasmid, a virus, or into the genomic DNA of a prokaryote or eukaryote. In addition, an isolated nucleic acid can include an engineered nucleic acid such as a DNA molecule that is part of a hybrid or fusion nucleic acid. A nucleic acid existing among hundreds to millions of other nucleic acids within, for example, cDNA libraries or genomic libraries, or gel slices containing a genomic DNA restriction digest, is not to be considered an isolated nucleic acid.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

As used herein, the term "percent sequence identity" refers to the degree of identity between any given query sequence, e.g., SEQ ID NO:81, and a subject sequence. A subject sequence typically has a length that is from 80 percent to 200 percent of the length of the query sequence, e.g., 82, 85, 87, 89, 90, 93, 95, 97, 99, 100, 105, 110, 115, 120, 130, 140, 150, 160, 170, 180, 190, or 200 percent of the length of the query sequence. A percent identity for any subject nucleic acid or polypeptide relative to a query nucleic acid or polypeptide can be determined as follows. A query sequence (e.g., a nucleic acid sequence or an amino acid sequence) is aligned to one or more subject sequences using the computer program ClustalW (version 1.83, default parameters), which allows alignments of nucleic acid or polypeptide sequences to be carried out across their entire length (global alignment). Chenna et al., *Nucleic Acids Res.*, 31(13):3497-500 (2003).

ClustalW calculates the best match between a query and one or more subject sequences, and aligns them so that identities, similarities and differences can be determined. Gaps of one or more residues can be inserted into a query sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site (searchlauncher.bcm.tmc.edu/multi-align/multi-align.html) and at the European Bioinformatics Institute site on the World Wide Web (ebi.ac.uk/clustalw).

To determine percent identity of a subject nucleic acid or amino acid sequence to a query sequence, the sequences are aligned using ClustalW, the number of identical matches in the alignment is divided by the length of the query sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

The term "exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

Recombinant constructs are also provided herein and can be used to transform plants or plant cells in order to modulate oil levels. A recombinant nucleic acid construct comprises a nucleic acid encoding an oil-modulating polypeptide as described herein, operably linked to a regulatory region suitable for expressing the oil-modulating polypeptide in the plant or cell. Thus, a nucleic acid can comprise a coding sequence that encodes any of the oil-modulating polypeptides as set forth in SEQ ID NOs:81-92, SEQ ID NO:94, SEQ ID NOs:96-107, SEQ ID NO:109, SEQ ID NOs:111-116, SEQ ID NOs:118-134, SEQ ID NOs:136-140, SEQ ID NO:142, SEQ ID NO:144, SEQ ID NOs:146-147, SEQ ID NOs:149-150, SEQ ID NO:152, SEQ ID NO:154, SEQ ID NOs:156-157, SEQ ID NOs:159-169, SEQ ID NOs:171-172, SEQ ID NO:174, SEQ ID NO:176, SEQ ID NOs:178-179, SEQ ID NOs:181-182, SEQ ID NOs:184-191, SEQ ID NOs:193-196, SEQ ID NOs:198-217, SEQ ID NOs:219-220, SEQ ID NOs:222-229, SEQ ID NOs:231-238, SEQ ID NO:240, SEQ ID NOs:242-250, SEQ ID NOs:252-330, SEQ ID NOs:332-333, SEQ ID NO:335, SEQ ID NOs:337-340, SEQ ID NO:342, SEQ ID NO:344, SEQ ID NO:346-348, SEQ ID NOs:350-357, SEQ ID NOs:359-366, SEQ ID NO:368, SEQ ID NOs: 370-372, SEQ ID NOs:374-376, SEQ ID NOs:378-379, SEQ ID NOs:381-396, SEQ ID NO:398, SEQ ID NOs:502-545, and the consensus sequences set forth in FIGS. 1-13. Examples of nucleic acids encoding oil-modulating polypeptides are set forth in SEQ ID NO:80, SEQ ID NO:93, SEQ ID NO:95, SEQ ID NO:108, SEQ ID NO:110, SEQ ID NO:117, SEQ ID NO:135, SEQ ID NO:141, SEQ ID NO:143, SEQ ID NO:145, SEQ ID NO:148, SEQ ID NO:151, SEQ ID NO:153, SEQ ID NO:155, SEQ ID NO:158, SEQ ID NO:170, SEQ ID NO:173, SEQ ID NO:175, SEQ ID NO:177, SEQ ID NO:180, SEQ ID NO:183, SEQ ID NO:192, SEQ ID NO:197, SEQ ID NO:218, SEQ ID NO:221, SEQ ID NO:230, SEQ ID NO:239, SEQ ID NO:241, SEQ ID NO:251, SEQ ID NO:331, SEQ ID NO:334, SEQ ID NO:336, SEQ ID NO:341, SEQ ID NO:343, SEQ ID NO:345, SEQ ID NO:349, SEQ ID NO:358, SEQ ID NO:367, SEQ ID NO:369, SEQ ID NO:373, SEQ ID NO:377, SEQ ID NO:380, SEQ ID NO:397, SEQ ID NOs:399-501, and SEQ ID NOs:546-575.

In some cases, a recombinant nucleic acid construct can include a nucleic acid comprising less than the full-length of a coding sequence. Typically, such a construct also includes a regulatory region operably linked to the oil-modulating nucleic acid. In some cases, a recombinant nucleic acid construct can include a nucleic acid comprising a coding sequence, a gene, or a fragment of a coding sequence or gene in an antisense orientation so that the antisense strand of RNA is transcribed.

It will be appreciated that a number of nucleic acids can encode a polypeptide having a particular amino acid sequence. The degeneracy of the genetic code is well known to the art; i.e., for many amino acids, there is more than one nucleotide triplet that serves as the codon for the amino acid. For example, codons in the coding sequence for a given oil-modulating polypeptide can be modified such that optimal expression in a particular plant species is obtained, using appropriate codon bias tables for that species.

Vectors containing nucleic acids such as those described herein also are provided. A "vector" is a replicon, such as a plasmid, phage, or cosmid, into which another DNA segment may be inserted so as to bring about the replication of the inserted segment. Generally, a vector is capable of replication when associated with the proper control elements. Suitable vector backbones include, for example, those routinely used in the art such as plasmids, viruses, artificial chromosomes, BACs, YACs, or PACs. The term "vector" includes cloning and expression vectors, as well as viral vectors and integrating vectors. An "expression vector" is a vector that includes a regulatory region. Suitable expression vectors include, without limitation, plasmids and viral vectors derived from, for example, bacteriophage, baculoviruses, and retroviruses. Numerous vectors and expression systems are commercially available from such corporations as Novagen (Madison, Wis.), Clontech (Palo Alto, Calif.), Stratagene (La Jolla, Calif.), and Invitrogen/Life Technologies (Carlsbad, Calif.).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., chlorosulfuron or phosphinothricin). In addition, an expression vector can include a tag sequence designed to facilitate manipulation or detection (e.g., purification or localization) of the expressed polypeptide. Tag sequences, such as green fluorescent protein (GFP), glutathione S-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus.

Regulatory Regions

The term "regulatory region" refers to nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof.

As used herein, the term "operably linked" refers to positioning of a regulatory region and a sequence to be transcribed in a nucleic acid so as to influence transcription or translation of such a sequence. For example, to bring a coding sequence under the control of a promoter, the translation initiation site of the translational reading frame of the polypeptide is typically positioned between one and about fifty nucleotides downstream of the promoter. A promoter can, however, be positioned as much as about 5,000 nucleotides upstream of the translation initiation site, or about 2,000 nucleotides upstream of the transcription start site. A promoter typically comprises at least a core (basal) promoter. A promoter also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell*, 1:977-984 (1989). The choice of promoters to be included depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence.

Some suitable regulatory regions initiate transcription only, or predominantly, in certain cell types, for example, a promoter that is active predominantly in a reproductive tissue such as fruit, ovule, pollen, pistils, female gametophyte, egg cell, central cell, nucellus, suspensor, synergid cell, flowers, embryonic tissue, embryo sac, embryo, zygote, endosperm, integument, or seed coat. Thus, as used herein a cell type- or tissue-preferential promoter is one that drives expression preferentially in the target tissue, but may also lead to some expression in other cell types or tissues as well. Methods for identifying and characterizing promoter regions in plant genomic DNA include, for example, those described in the following references: Jordano et al., *Plant Cell*, 1:855-866 (1989); Bustos et al., *Plant Cell*, 1:839-854 (1989); Green et al., *EMBO J.*, 7:4035-4044 (1988); Meier et al., *Plant Cell*, 3:309-316 (1991); and Zhang et al., *Plant Physiology*, 110: 1069-1079 (1996).

Examples of various classes of regulatory regions are described below. Some of the regulatory regions indicated below as well as additional regulatory regions are described in more detail in U.S. Patent Application Ser. Nos. 60/505, 689; 60/518,075; 60/544,771; 60/558,869; 60/583,691; 60/619,181; 60/637,140; 60/757,544; 60/776,307; Ser. Nos. 10/957,569; 11/058,689; 11/172,703; 11/208,308; 11/274, 890; 60/583,609; 60/612,891; 11/097,589; 11/233,726;

11/408,791; 11/414,142; 10/950,321; 11/360,017; PCT/US05/011105; PCT/US05/034308; and PCT/US05/23639. Nucleotide sequences of promoters are set forth in SEQ ID NOs:1-79 and 259-274. It will be appreciated that a regulatory region may meet criteria for one classification based on its activity in one plant species, and yet meet criteria for a different classification based on its activity in another plant species.

Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326 (SEQ ID NO:76), YP0144 (SEQ ID NO:55), YP0190 (SEQ ID NO:59), p13879 (SEQ ID NO:75), YP0050 (SEQ ID NO:35), p32449 (SEQ ID NO:77), 21876 (SEQ ID NO:1), YP0158 (SEQ ID NO:57), YP0214 (SEQ ID NO:61), YP0380 (SEQ ID NO:70), PT0848 (SEQ ID NO:26), and PT0633 (SEQ ID NO:7) promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128 (SEQ ID NO:52), YP0275 (SEQ ID NO:63), PT0625 (SEQ ID NO:6), PT0660 (SEQ ID NO:9), PT0683 (SEQ ID NO:14), and PT0758 (SEQ ID NO:22) promoters. Other root-preferential promoters include the PT0613 (SEQ ID NO:5), PT0672 (SEQ ID NO:11), PT0688 (SEQ ID NO:15), and PT0837 (SEQ ID NO:24) promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA*, 86:7890-7894 (1989)), root cell specific promoters reported by Conkling et al., *Plant Physiol.*, 93:1203-1211 (1990), and the tobacco RD2 promoter.

Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell*, 1(9):839-853 (1989)), the soybean trypsin inhibitor promoter (Riggs et al., *Plant Cell*, 1(6):609-621 (1989)), the ACP promoter (Baerson et al., *Plant Mol. Biol.*, 22(2):255-267 (1993)), the stearoyl-ACP desaturase promoter (Slocombe et al., *Plant Physiol.*, 104(4):167-176 (1994)), the soybean α' subunit of β-conglycinin promoter (Chen et al., *Proc. Natl. Acad. Sci. USA*, 83:8560-8564 (1986)), the oleosin promoter (Hong et al., *Plant Mol. Biol.*, 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell Biol.*, 13:5829-5842 (1993)), the beta-amylase promoter, and the barley hordein promoter. Other maturing endosperm promoters include the YP0092 (SEQ ID NO:38), PT0676 (SEQ ID NO:12), and PT0708 (SEQ ID NO:17) promoters.

Ovary Tissue Promoters

Promoters that are active in ovary tissues such as the ovule wall and mesocarp can also be useful, e.g., a polygalacturonidase promoter, the banana TRX promoter, the melon actin promoter, YP0396 (SEQ ID NO:74), and PT0623 (SEQ ID NO:273). Examples of promoters that are active primarily in ovules include YP0007 (SEQ ID NO:30), YP0111 (SEQ ID NO:46), YP0092 (SEQ ID NO:38), YP0103 (SEQ ID NO:43), YP0028 (SEQ ID NO:33), YP0121 (SEQ ID NO:51), YP0008 (SEQ ID NO:31), YP0039 (SEQ ID NO:34), YP0115 (SEQ ID NO:47), YP0119 (SEQ ID NO:49), YP0120 (SEQ ID NO:50), and YP0374 (SEQ ID NO:68).

Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmycl (see, Urao (1996) *Plant Mol. Biol.*, 32:571-57; Conceicao (1994) *Plant*, 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics*, 142:1009-1020); maize Cat3 (see, GenBank No. L05934; Abler (1993) *Plant Mol. Biol.*, 22:10131-1038). Other promoters include the following *Arabidopsis* promoters: YP0039 (SEQ ID NO:34), YP0101 (SEQ ID NO:41), YP0102 (SEQ ID NO:42), YP0110 (SEQ ID NO:45), YP0117 (SEQ ID NO:48), YP0119 (SEQ ID NO:49), YP0137 (SEQ ID NO:53), DME, YP0285 (SEQ ID NO:64), and YP0212 (SEQ ID NO:60). Other promoters that may be useful include the following rice promoters: p530c10 (SEQ ID NO:576), pOsFIE2-2 (SEQ ID NO:577), pOsMEA (SEQ ID NO:578), pOsYp102 (SEQ ID NO:579), and pOsYp285 (SEQ ID NO:580).

Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* (2001) 20:647-654), YP0097 (SEQ ID NO:40), YP0107 (SEQ ID NO:44), YP0088 (SEQ ID NO:37), YP0143 (SEQ ID NO:54), YP0156 (SEQ ID NO:56), PT0650 (SEQ ID NO:8), PT0695 (SEQ ID NO:16), PT0723 (SEQ ID NO:19), PT0838 (SEQ ID NO:25), PT0879 (SEQ ID NO:28), and PT0740 (SEQ ID NO:20).

Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104: 997-1006 (1994)), the cab IR promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA*, 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535 (SEQ ID NO:3), PT0668 (SEQ ID NO:2), PT0886 (SEQ ID NO:29), PR0924 (SEQ ID NO:78), YP0144 (SEQ ID NO:55), YP0380 (SEQ ID NO:70), and PT0585 (SEQ ID NO:4).

Vascular Tissue Promoters

Examples of promoters that have high or preferential activity in vascular bundles include YP0087 (SEQ ID NO:583), YP0093 (SEQ ID NO:584), YP0108 (SEQ ID NO:585), YP0022 (SEQ ID NO:586), and YP0080 (SEQ ID NO:587). Other vascular tissue-preferential promoters include the glycine-rich cell wall protein GRP 1.8 promoter (Keller and Baumgartner, *Plant Cell*, 3(10):1051-1061 (1991)), the Commelina yellow mottle virus (COYMV) promoter (Medberry et al., *Plant Cell*, 4(2):185-192 (1992)), and the rice tungro bacilliform virus (RTBV) promoter (Dai et al., *Proc. Natl. Acad. Sci. USA*, 101(2):687-692 (2004)).

Inducible Promoters

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380 (SEQ ID NO:70), PT0848 (SEQ ID NO:26), YP0381 (SEQ ID NO:71), YP0337 (SEQ ID NO:66), PT0633 (SEQ ID NO:7), YP0374 (SEQ ID NO:68), PT0710 (SEQ ID NO:18), YP0356 (SEQ ID NO:67), YP0385 (SEQ ID NO:73), YP0396 (SEQ ID NO:74), YP0388 (SEQ ID NO:588), YP0384 (SEQ ID NO:72), PT0688 (SEQ ID NO:15), YP0286 (SEQ ID NO:65), YP0377 (SEQ ID NO:69), PD1367 (SEQ ID NO:79), and PD0901 (SEQ ID NO:589. Nitrogen-inducible promoters include PT0863 (SEQ ID NO:27), PT0829 (SEQ ID NO:23), PT0665 (SEQ ID NO:10), and PT0886 (SEQ ID NO:29). Examples of a shade-inducible promoters are PR0924 (SEQ ID NO:78) and PT0678 (SEQ ID NO:13).

Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

Other Promoters

Other classes of promoters include, but are not limited to, leaf-preferential, stem/shoot-preferential, callus-preferential, guard cell-preferential, such as PT0678 (SEQ ID NO:13), tuber-preferential, parenchyma cell-preferential, and senescence-preferential promoters. Promoters designated YP0086 (SEQ ID NO:36), YP0188 (SEQ ID NO:58), YP0263 (SEQ ID NO:62), PT0758 (SEQ ID NO:22), PT0743 (SEQ ID NO:21), PT0829 (SEQ ID NO:23), YP0119 (SEQ ID NO:49), and YP0096 (SEQ ID NO:39), as described in the above-referenced patent applications, may also be useful.

Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding an oil-modulating polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

Transgenic Plants and Plant Cells

The invention also features transgenic plant cells and plants comprising at least one recombinant nucleic acid construct described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Transgenic plant cells used in methods described herein can constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species, or for further selection of other desirable traits. Alternatively, transgenic plants can be propagated vegetatively for those species amenable to such techniques. As used herein, a transgenic plant also refers to progeny of an initial transgenic plant. Progeny includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. The designation $F_1$ refers to the progeny of a cross between two parents that are genetically distinct. The designations $F_2$, $F_3$, $F_4$, $F_5$ and $F_6$ refer to subsequent generations of self- or sib-pollinated progeny of an $F_1$ plant. Seeds produced by a transgenic plant can be grown and then selfed (or outcrossed and selfed) to obtain seeds homozygous for the nucleic acid construct.

Transgenic plants can be grown in suspension culture, or tissue or organ culture. For the purposes of this invention, solid and/or liquid tissue culture techniques can be used. When using solid medium, transgenic plant cells can be placed directly onto the medium or can be placed onto a filter that is then placed in contact with the medium. When using liquid medium, transgenic plant cells can be placed onto a flotation device, e.g., a porous membrane that contacts the liquid medium. Solid medium typically is made from liquid medium by adding agar. For example, a solid medium can be Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous oil-modulating polypeptide whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880; 5,204,253; 6,329,571 and 6,013,863. If a cell or cultured tissue is used as the recipient tissue for transformation, plants can be regenerated from transformed cultures if desired, by techniques known to those skilled in the art.

In aspects related to making transgenic plants, a typical step involves selection or screening of transformed plants, e.g., for the presence of a functional vector as evidenced by expression of a selectable marker. Selection or screening can be carried out among a population of recipient cells to identify transformants using selectable marker genes such as herbicide resistance genes. Physical and biochemical methods can be used to identify transformants. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known.

A population of transgenic plants can be screened and/or selected for those members of the population that have a desired trait or phenotype conferred by expression of the transgene. For example, a population of progeny of a single transformation event can be screened for those plants having a desired level of expression of a heterologous oil-modulating polypeptide or nucleic acid. As an alternative, a population of plants comprising independent transformation events can be screened for those plants having a desired trait, such as a modulated level of oil. Selection and/or screening can be carried out over one or more generations, which can be useful to identify those plants that have a statistically significant difference in an oil level as compared to a corresponding level in a control plant. Selection and/or screening can also be carried out in more than one geographic location. In some cases, transgenic plants can be grown and selected under conditions which induce a desired phenotype or are otherwise necessary to produce a desired phenotype in a transgenic plant. In addition, selection and/or screening can be carried out during a particular developmental stage in which the phenotype is expected to be exhibited by the plant. Selection and/or screening can be carried out to choose those transgenic plants having a statistically significant difference in an oil level relative to a control plant that lacks the transgene. Selected or screened transgenic plants have an altered phenotype as compared to a corresponding control plant, as described in the "Transgenic Plant Phenotypes" section below.

Plant Species

The polynucleotides and vectors described herein can be used to transform a number of monocotyledonous and dicotyledonous plants and plant cell systems, including dicots such as alfalfa, almond, amaranth, apple, apricot, avocado, beans (including kidney beans, lima beans, dry beans, green beans), broccoli, cabbage, canola, carrot, cashew, castor bean, cherry, chick peas, chicory, clover, cocoa, coffee, cotton, crambe, flax, grape, grapefruit, hazelnut, hemp, jatropha, jojoba, lemon, lentils, lettuce, linseed, mango, melon (e.g., watermelon, cantaloupe), mustard, neem, olive, orange, peach, peanut, pear, peas, pepper, plum, poppy, potato, pumpkin, oilseed rape, rapeseed (high erucic acid and canola), safflower, sesame, soybean, spinach, strawberry, sugar beet, sunflower, sweet potatoes, tea, tomato, walnut, and yams, as well as monocots such as banana, barley, bluegrass, coconut, date palm, fescue, field corn, garlic, millet, oat, oil palm, onion, palm kernel oil, pineapple, popcorn, rice, rye, ryegrass, sorghum, sudangrass, sugarcane, sweet corn, switchgrass, timothy, and wheat. Brown seaweeds, green seaweeds, red seaweeds, and microalgae can also be used.

Thus, the methods and compositions described herein can be used with dicotyledonous plants belonging, for example, to the orders Apiales, Arecales, Aristochiales, Asterales, Batales, Campanulales, Capparales, Caryophyllales, Casuarinales, Celastrales, Cornales, Cucurbitales, Diapensales, Dilleniaes, Dipsacales, Ebenales, Ericales, Eucomiales, Euphorbiales, Fabales, Fagales, Gentianales, Geraniales, Haloragales, Hamamelidales, Illiciales, Juglandales, Lamiales, Laurales, Lecythidales, Leitneriales, Linales, Magniolales, Malvales, Myricales, Myrtales, Nymphaeales, Papaverales, Piperales, Plantaginales, Plumbaginales, Podostemales, Polemoniales, Polygalales, Polygonales, Primulales, Proteales, Rafflesiales, Ranunculales, Rhamnales, Rosales, Rubiales, Salicales, Santales, Sapindales, Sarraceniaceae, Scrophulariales, Solanales, Trochodendrales, Theales, Umbellales, Urticales, and Violales. The methods and compositions described herein also can be utilized with monocotyledonous plants such as those belonging to the orders Alismatales, Arales, Arecales, Asparagales, Bromeliales, Commelinales, Cyclanthales, Cyperales, Eriocaulales, Hydrocharitales, Juncales, Liliales, Najadales, Orchidales, Pandanales, Poales, Restionales, Triuridales, Typhales, Zingiberales, and with plants belonging to Gymnospermae, e.g., *Cycadales, Ginkgoales, Gnetales*, and *Pinales*.

The methods and compositions can be used over a broad range of plant species, including species from the dicot genera *Amaranthus, Anacardium, Arachis, Azadirachta, Brassica, Calendula, Camellia, Canarium, Cannabis, Capsicum, Carthainus, Cicer, Cichorium, Cinnamomum, Citrus, Citrullus, Coffea, Corylus, Crambe, Cucumis, Cucurbita, Daucus, Dioscorea, Fragaria, Glycine, Gossypium, Helianthus, Jatropha, Juglans, Lactuca, Lens, Linum, Lycopersicon, Malus, Mangifera, Medicago, Mentha, Nicotiana, Ocimum, Olea, Papaver, Persea, Phaseolus, Pistacia, Pisum, Prunus, Pyrus, Ricinus, Rosmarinus, Salvia, Sesamum, Simmondsia, Solanum, Spinacia, Theobroma, Thymus, Trifolium, Vaccinium, Vigna*, and *Vitis*; and the monocot genera *Allium, Ananas, Asparagus, Avena, Cocos, Curcuma, Elaeis, Festuca, Festulolium, Hordeum, Lemna, Lolium, Musa, Oryza, Panicum, Pennisetum, Phleum, Poa, Saccharum, Secale, Sorghum, Triticosecale, Triticuni*, and *Zea*; and the gymnosperm genera *Abies, Cunninghamia, Picea, Pinus, Populus*, and *Pseudotsuga*.

The methods and compositions described herein also can be used with brown seaweeds, e.g., *Ascophyllum nodosum, Fucus vesiculosus, Fucus serratus, Himanthalia elongata*, and *Undaria pinnatifida*; red seaweeds, e.g., *Chondrus crispus, Cracilaria verrucosa, Porphyra umbilicalis*, and *Palmaria palmata*; green seaweeds, e.g., *Enteromorpha* spp. and *Ulva* spp.; and microalgae, e.g., *Spirulina* spp. (*S. platensis* and *S. maxima*) and *Odontella aurita*. In addition, the methods and compositions can be used with *Crypthecodinium cohnii, Schizochytrium* spp., and *Haematococcus pluvialis*.

In some embodiments, a plant is a member of the species *Arachis hypogea, Brassica* spp., *Carthamus tinctorius, Elaeis oleifera, Glycine max, Gossypium* spp., *Helianthus annuus, Jatropha curcas, Linum usitatissimum, Triticum aestivum*, or *Zea mays*.

Expression of Oil-Modulating Polypeptides

The polynucleotides and recombinant vectors described herein can be used to express an oil-modulating polypeptide in a plant species of interest. The term "expression" refers to the process of converting genetic information of a polynucleotide into RNA through transcription, which is catalyzed by an enzyme, RNA polymerase, and into protein, through translation of mRNA on ribosomes. "Up-regulation" or "activation" refers to regulation that increases the production of expression products (mRNA, polypeptide, or both) relative to basal or native states, while "down-regulation" or "repression" refers to regulation that decreases production of expression products (mRNA, polypeptide, or both) relative to basal or native states.

The polynucleotides and recombinant vectors described herein can be used to inhibit expression of an oil-modulating polypeptide in a plant species of interest. A number of nucleic acid based methods, including antisense RNA, ribozyme directed RNA cleavage, post-transcriptional gene silencing (PTGS), e.g., RNA interference (RNAi), and transcriptional gene silencing (TGS) can be used to inhibit gene expression in plants. Antisense technology is one well-known method. In this method, a nucleic acid segment from a gene to be repressed is cloned and operably linked to a regulatory region and a transcription termination sequence so that the antisense strand of RNA is transcribed. The recombinant vector is then transformed into plants, as described herein, and the antisense strand of RNA is produced. The nucleic acid segment need not be the entire sequence of the gene to be repressed, but typically will be substantially complementary to at least a portion of the sense strand of the gene to be repressed. Generally, higher homology can be used to compensate for the use of a shorter sequence. Typically, a sequence of at least 30 nucleotides is used, e.g., at least 40, 50, 80, 100, 200, 500 nucleotides or more.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contain a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad. Sci. USA*, 92(13): 6175-6179 (1995); de Feyter and Gaudron, Methods in Molecular Biology, Vol. 74, Chapter 43, "Expressing Ribozymes in Plants", Edited by Turner, P.C., Humana Press Inc., Totowa, N.J. RNA endoribonucleases which have been described, such as the one that occurs naturally in *Tetrahymena thermophila*, can be useful. See, for example, U.S. Pat. Nos. 4,987,071 and 6,423,885.

PTGS, e.g., RNAi, can also be used to inhibit the expression of a gene. For example, a construct can be prepared that includes a sequence that is transcribed into an RNA that can anneal to itself, e.g., a double stranded RNA having a stem-loop structure. In some embodiments, one strand of the stem portion of a double stranded RNA comprises a sequence that is similar or identical to the sense coding sequence of an oil-modulating polypeptide, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand of the coding sequence of the oil-modulating polypeptide, and can have a length that is shorter, the same as, or longer than the corresponding length of the sense sequence. In some cases, one strand of the stem portion of a double stranded RNA comprises a sequence that is similar or identical to the 3' or 5' untranslated region of an mRNA encoding an oil-modulating polypeptide, and the other strand of the stem portion of the double stranded RNA comprises a sequence that is similar or identical to the sequence that is complementary to the 3' or 5' untranslated region, respectively, of the mRNA encoding the oil-modulating polypeptide. In other embodiments, one strand of the stem portion of a double stranded RNA comprises a sequence that is similar or identical to the sequence of an intron in the pre-mRNA encoding an oil-modulating polypeptide, and the other strand of the stem portion comprises a sequence that is similar or identical to the sequence that is complementary to the sequence of the intron in the pre-mRNA. The loop portion of a double stranded RNA can be from 3 nucleotides to 5,000 nucleotides, e.g., from 3 nucleotides to 25 nucleotides, from 15 nucleotides to 1,000 nucleotides, from 20 nucleotides to 500 nucleotides, or from 25 nucleotides to 200 nucleotides. The loop portion of the RNA can include an intron. A double stranded RNA can have zero, one, two, three, four, five, six, seven, eight, nine, ten, or more stem-loop structures. A construct including a sequence that is operably linked to a regulatory region and a transcription termination sequence, and that is transcribed into an RNA that can form a double stranded RNA, is transformed into plants as described herein. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

Constructs containing regulatory regions operably linked to nucleic acid molecules in sense orientation can also be used to inhibit the expression of a gene. The transcription product can be similar or identical to the sense coding sequence of an oil-modulating polypeptide. The transcription product can also be unpolyadenylated, lack a 5' cap structure, or contain an unsplicable intron. Methods of inhibiting gene expression using a full-length cDNA as well as a partial cDNA sequence are known in the art. See, e.g., U.S. Pat. No. 5,231,020.

In some embodiments, a construct containing a nucleic acid having at least one strand that is a template for both sense and antisense sequences that are complementary to each other is used to inhibit the expression of a gene. The sense and antisense sequences can be part of a larger nucleic acid molecule or can be part of separate nucleic acid molecules having sequences that are not complementary. The sense or antisense sequence can be a sequence that is identical or complementary to the sequence of an mRNA, the 3' or 5' untranslated region of an mRNA, or an intron in a pre-mRNA encoding an oil-modulating polypeptide. In some embodiments, the sense or antisense sequence is identical or complementary to a sequence of the regulatory region that drives transcription of the gene encoding an oil-modulating polypeptide. In each case, the sense sequence is the sequence that is complementary to the antisense sequence.

The sense and antisense sequences can be any length greater than about 12 nucleotides (e.g., 13, 14, 15, 16, 17, 18, 19, 20, 21, 22, 23, 24, 25, 26, 27, 28, 29, 30, or more nucleotides). For example, an antisense sequence can be 21 or 22 nucleotides in length. Typically, the sense and antisense sequences range in length from about 15 nucleotides to about 30 nucleotides, e.g., from about 18 nucleotides to about 28 nucleotides, or from about 21 nucleotides to about 25 nucleotides.

In some embodiments, an antisense sequence is a sequence complementary to an mRNA sequence encoding an oil-modulating polypeptide described herein. The sense sequence complementary to the antisense sequence can be a sequence present within the mRNA of the oil-modulating polypeptide. Typically, sense and antisense sequences are designed to correspond to a 15-30 nucleotide sequence of a target mRNA such that the level of that target mRNA is reduced.

In some embodiments, a construct containing a nucleic acid having at least one strand that is a template for more than one sense sequence (e.g., 2, 3, 4, 5, 6, 7, 8, 9, 10 or more sense sequences) can be used to inhibit the expression of a gene. Likewise, a construct containing a nucleic acid having at least one strand that is a template for more than one antisense sequence (e.g., 2, 3, 4, 5, 6, 7, 8, 9, 10 or more antisense sequences) can be used to inhibit the expression of a gene. For example, a construct can contain a nucleic acid having at least one strand that is a template for two sense sequences and two antisense sequences. The multiple sense sequences can be identical or different, and the multiple antisense sequences can be identical or different. For example, a construct can have a nucleic acid having one strand that is a template for two identical sense sequences and two identical antisense sequences that are complementary to the two identical sense sequences. Alternatively, an isolated nucleic acid can have one strand that is a template for (1) two identical sense sequences 20 nucleotides in length, (2) one antisense sequence that is complementary to the two identical sense sequences 20 nucleotides in length, (3) a sense sequence 30 nucleotides in length, and (4) three identical antisense sequences that are complementary to the sense sequence 30 nucleotides in length. The constructs provided herein can be designed to have any arrangement of sense and antisense sequences. For example, two identical sense sequences can be followed by two identical antisense sequences or can be positioned between two identical antisense sequences.

A nucleic acid having at least one strand that is a template for one or more sense and/or antisense sequences can be operably linked to a regulatory region to drive transcription of an RNA molecule containing the sense and/or antisense sequencers). In addition, such a nucleic acid can be operably linked to a transcription terminator sequence, such as the terminator of the nopaline synthase (nos) gene. In some cases, two regulatory regions can direct transcription of two transcripts: one from the top strand, and one from the bottom strand. See, for example, Yan et al., *Plant Physiol.*, 141:1508-1518 (2006). The two regulatory regions can be the same or different. The two transcripts can form double-stranded RNA molecules that induce degradation of the target RNA. In some cases, a nucleic acid can be positioned within a T-DNA or P-DNA such that the left and right T-DNA border sequences, or the left and right border-like sequences of the P-DNA, flank or are on either side of the nucleic acid. The nucleic acid sequence between the two regulatory regions can be from about 15 to about 300 nucleotides in length. In some embodiments, the nucleic acid sequence between the two regulatory regions is from about 15 to about 200 nucleotides in length, from about 15 to about 100 nucleotides in length, from about 15 to about 50 nucleotides in length, from about 18 to about 50 nucleotides in length, from about 18 to about 40 nucleotides in length, from about 18 to about 30 nucleotides in length, or from about 18 to about 25 nucleotides in length.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, 1997, *Antisense Nucleic Acid Drug Dev.*, 7:187-195; Hyrup et al., *Bioorgan. Med. Chem.*, 4:5-23 (1996). In addition, the deoxyphosphate backbone can be replaced with, for example, a phosphorothioate or phosphorodithioate backbone, a phosphoroamidite, or an alkyl phosphotriester backbone.

Transgenic Plant Phenotypes

In some embodiments, a plant in which expression of an oil-modulating polypeptide is modulated can have increased levels of seed oil. For example, an oil-modulating polypeptide described herein can be expressed in a transgenic plant, resulting in increased levels of seed oil. The seed oil level can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, or more than 75 percent, as compared to the seed oil level in a corresponding control plant that does not express the transgene. In some embodiments, a plant in which expression of an oil-modulating polypeptide is modulated can have decreased levels of seed oil. The seed oil level can be decreased by at least 2 percent, e.g., 2, 3, 4, 5, 10, 15, 20, 25, 30, 35, or more than 35 percent, as compared to the seed oil level in a corresponding control plant that does not express the transgene.

Plants for which modulation of levels of seed oil can be useful include, without limitation, almond, cashew, castor bean, coconut, corn, cotton, flax, hazelnut, hemp, jatropha, linseed, mustard, neem, oil palm, peanut, poppy, pumpkin, rapeseed, rice, safflower, sesame seed, soybean, sunflower, and walnut. Increases in seed oil in such plants can provide increased yields of oil extracted from the seed and increased caloric content in foodstuffs and animal feed produced from the seed. Decreases in seed oil in such plants can be useful in situations where caloric intake should be restricted.

In some embodiments, a plant in which expression of an oil-modulating polypeptide is modulated can have increased or decreased levels of oil in one or more non-seed tissues, e.g., leaf tissues, stem tissues, root or corn tissues, or fruit tissues other than seed. For example, the oil level can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, 65, 70, 75 or more than 75 percent, as compared to the oil level in a corresponding control plant that does not express the transgene. In some embodiments, a plant in which expression of an oil-modulating polypeptide is modulated can have decreased levels of oil in one or more non-seed tissues. The oil level can be decreased by at least 2 percent, e.g., 2, 3, 4, 5, 10, 15, 20, 25, 30, 35, or more than 35 percent, as compared to the oil level in a corresponding control plant that does not express the transgene.

Plants for which modulation of levels of oil in non-seed tissues can be useful include, without limitation, alfalfa, apple, avocado, beans, carrot, cherry, coconut, coffee, grapefruit, lemon, lettuce, oat, olive, onion, orange, palm, peach, peanut, pear, pineapple, potato, ryegrass, sudangrass, switchgrass, and tomato. Increases in non-seed oil in such plants can provide increased oil and caloric content in edible plants, including animal forage.

In some embodiments, a plant in which expression of an oil-modulating polypeptide having an amino acid sequence corresponding to SEQ ID NO:94, SEQ ID NO:81, SEQ ID NO:111, or SEQ ID NO:136 is modulated can have increased levels of seed protein accompanying increased levels of seed oil. The protein level can be increased by at least 2 percent, e.g., 2, 3, 4, 5, 10, 15, 20, 25, 30, 35, or 40 percent, as compared to the protein level in a corresponding control plant that does not express the transgene.

Typically, a difference (e.g., an increase) in the amount of oil or protein in a transgenic plant or cell relative to a control plant or cell is considered statistically significant at $p \leq 0.05$ with an appropriate parametric or non-parametric statistic, e.g., Chi-square test, Student's t-test, Mann-Whitney test, or F-test. In some embodiments, a difference in the amount of oil or protein is statistically significant at $p<0.01$, $p<0.005$, or $p<0.001$. A statistically significant difference in, for example, the amount of oil in a transgenic plant compared to the amount in cells of a control plant indicates that the recombinant nucleic acid present in the transgenic plant results in altered oil levels.

The phenotype of a transgenic plant is evaluated relative to a control plant that does not express the exogenous polynucleotide of interest, such as a corresponding wild type plant, a corresponding plant that is not transgenic for the exogenous polynucleotide of interest but otherwise is of the same genetic background as the transgenic plant of interest, or a corresponding plant of the same genetic background in which expression of the polypeptide is suppressed, inhibited, or not induced (e.g., where expression is under the control of an inducible promoter). A plant is said "not to express" a polypeptide when the plant exhibits less than 10%, e.g., less than 9%, 8%, 7%, 6%, 5%, 4%, 3%, 2%, 1%, 0.5%, 0.1%, 0.01%, or 0.001%, of the amount of polypeptide or mRNA encoding the polypeptide exhibited by the plant of interest. Expression can be evaluated using methods including, for example, RT-PCR, Northern blots, S1 RNase protection, primer extensions, Western blots, protein gel electrophoresis, immunoprecipitation, enzyme-linked immunoassays, chip assays, and mass spectrometry. It should be noted that if a polypeptide is expressed under the control of a tissue-preferential or broadly expressing promoter, expression can be evaluated in the entire plant or in a selected tissue. Similarly, if a polypeptide is expressed at a particular time, e.g., at a particular time in development or upon induction, expression can be evaluated selectively at a desired time period.

Information that the polypeptides disclosed herein can modulate oil content can be useful in breeding of crop plants. Based on the effect of disclosed polypeptides on oil content, one can search for and identify polymorphisms linked to genetic loci for such polypeptides. Polymorphisms that can be identified include simple sequence repeats (SSRs), rapid amplification of polymorphic DNA (RAPDs), amplified fragment length polymorphisms (AFLPs) and restriction fragment length polymorphisms (RFLPs).

If a polymorphism is identified, its presence and frequency in populations analyzed to determine if it is statistically significantly correlated to an alteration in oil content. Those polymorphisms that are correlated with an alteration in oil content can be incorporated into a marker assisted breeding program to facilitate the development of lines that have a desired alteration in oil content. Typically, a polymorphism identified in such a manner is used with polymorphisms at other loci that are also correlated with a desired alteration in oil content.

Articles of Manufacture

Transgenic plants provided herein have particular uses in the agricultural and nutritional industries. For example, transgenic plants described herein can be used to make food products and animal feed. Suitable plants with which to make such products include almond, avocado, cashew, coconut, corn, flax, olive, peanut, soybean, sunflower, and walnut. Such products are useful to provide desired oil and caloric content in the diet.

Transgenic plants provided herein can also be used to make vegetable oil. Vegetable oils can be chemically extracted from transgenic plants using a solvent, such as hexane. In some cases, olive, coconut and palm oils can be produced by mechanical extraction, such as expeller-pressed extraction. Oil presses, such as the screw press and the ram press, can also be used. Suitable plants from which to make oil include almond, apricot, avocado, canola, cashew, castor bean, coconut, corn, cotton, flax, grape, hazelnut, hemp, mustard, neem, olive, palm, peanut, poppy, pumpkin, rapeseed, rice, safflower, sesame, soybean, sunflower, and walnut. Such oils can be used for frying, baking, and spray coating applications. Vegetable oils also can be used to make margarine, processed foods, oleochemicals, and essential oils. Vegetable oils are used in the electrical industry as insulators. Vegetable oils are also used as lubricants. Vegetable oil derivatives can be used in the manufacture of polymers.

Vegetable oil from transgenic plants provided herein can also be used as fuel. For example, vegetable oil can be used as fuel in a vehicle that heats the oil before it enters the fuel system. Heating vegetable oil to 150° F. reduces the viscosity of the oil sufficiently for use in diesel engines, such as Mercedes-Benz® diesel engines. The viscosity of the oil can also be reduced before it enters the tank so that neither the engine or the vehicle needs modification. Methods of reducing oil viscosity include: transesterification, pyrolysis, micro emulsion, blending and thermal depolymerization. The transesterification refining process creates esters from vegetable oil by using an alcohol in the presence of a catalyst. This reaction takes a triglyceride molecule, or a complex fatty acid, neutralizes the free fatty acids and removes the glycerin, thereby creating an alcohol ester. One method of transesterification mixes methanol with sodium hydroxide and then aggressively mixes the resulting methoxide with vegetable oil, which results in a methyl ester. Ester-based oxygenated fuel made from vegetable oil is known as biodiesel. Biodiesel can be used as a pure fuel or blended with petroleum in any percentage. B5 biodiesel, for example, is a blend of 5% biodiesel and 95% petroleum diesel. B20 biodiesel, including BioWillie® diesel fuel, is produced by blending 20% biodiesel and 80% petroleum diesel.

Use of biodiesel is beneficial for the environment because it is associated with reduced emissions compared to the use of petroleum diesel. In addition, biodiesel is a biodegradable, nontoxic fuel that is made from renewable materials. Plants that can be used as sources of oil for biodiesel production include canola, cotton, flax, jatropha, oil palm, safflower, soybean, and sunflower.

Seeds of transgenic plants described herein can be conditioned and bagged in packaging material by means known in the art to form an article of manufacture. Packaging material such as paper and cloth are well known in the art. A package of seed can have a label e.g., a tag or label secured to the packaging material, a label printed on the packaging material, or a label inserted within the package. The label can indicate that plants grown from the seeds contained within the package can produce a crop having an altered level of oil relative to corresponding control plants.

The invention will be further described in the following examples, which do not limit the scope of the invention described in the claims.

EXAMPLES

Example 1

Transgenic Plants

The following symbols are used in the Examples: $T_1$: first generation transformant; $T_2$: second generation, progeny of self-pollinated $T_1$ plants; $T_3$: third generation, progeny of self-pollinated $T_2$ plants; $T_4$: fourth generation, progeny of self-pollinated $T_3$ plants. Independent transformations are referred to as events.

The following is a list of nucleic acids that were isolated from *Arabidopsis thaliana* plants. Ceres Clone 25429 (At3g44590; SEQ ID NO:93) is a cDNA clone that is predicted to encode a 113 amino acid (SEQ ID NO:94) ribosomal polypeptide. Ceres Clone 41573 (At5g15140; SEQ ID NO:80) is a cDNA clone that is predicted to encode a 298 amino acid (SEQ ID NO:81) aldose 1-epimerase polypeptide. Ceres Clone 5750 (At2g27960; SEQ ID NO:110) is a cDNA clone that is predicted to encode an 87 amino acid (SEQ ID NO:111) cyclin-dependent kinase regulatory subunit polypeptide. Ceres Clone 121021 (SEQ ID NO:151) is a DNA clone that is predicted to encode a 199 amino acid (SEQ ID NO:152) polypeptide. Ceres Clone 158765 (SEQ ID NO:158) is a DNA clone that is predicted to encode a 149 amino acid (SEQ ID NO:159) polypeptide. Ceres Clone 16403 (SEQ ID NO:170) is a DNA clone that is predicted to encode a 238 amino acid (SEQ ID NO:171) PsbP polypeptide. Ceres Clone 19244 (SEQ ID NO:175) is a DNA clone that is predicted to encode a 220 amino acid (SEQ ID NO:176) AP2 domain-containing polypeptide. Ceres Clone 28635 (SEQ ID NO:177) is a DNA clone that is predicted to encode a 410 amino acid (SEQ ID NO:178) squalene/phytoene synthase polypeptide. Ceres Clone 35698 (SEQ ID NO:192) is a DNA clone that is predicted to encode a 109 amino acid (SEQ ID NO:193) ubiquitin-conjugating enzyme polypeptide. Ceres Clone 36412 (SEQ ID NO:331) is a DNA clone that is predicted to encode a 358 amino acid (SEQ ID NO:332) polypeptide. Ceres Clone 368 (SEQ ID NO:341) is a DNA clone that is predicted to encode a 52 amino acid (SEQ ID NO:342) polypeptide. Ceres Clone 41046 (SEQ ID NO:343) is a DNA clone that is predicted to encode a 220 amino acid (SEQ ID NO:344) cytochrome p450 polypeptide. Ceres Clone 4829 (SEQ ID NO:345) is a DNA clone that is predicted to encode a 180 amino acid (SEQ ID NO:346) polypeptide having a DUF662 domain. Ceres Clone 5426 (SEQ ID NO:358) is a DNA clone that is predicted to encode a 143 amino acid (SEQ ID NO:359) ribosomal L28e protein family polypeptide. Ceres Clone 7894 (SEQ ID NO:373) is a DNA clone that is predicted to encode a 512 amino acid (SEQ ID NO:374) Major Facilitator Superfamily transporter polypeptide. Ceres Clone 8161 (SEQ ID NO:397) is a cDNA clone that is predicted to encode a 218 amino acid (SEQ ID NO:398) polypeptide.

Ceres Clone 218626 (SEQ ID NO:135) is a cDNA clone that was isolated from *Zea mays* and that is predicted to encode a 454 amino acid (SEQ ID NO:136) tryptophan/tyrosine permease family polypeptide.

Each isolated nucleic acid described above was cloned into a Ti plasmid vector, CRS 338, containing a phosphinothricin acetyltransferase gene which confers Finale™ resistance to transformed plants. Constructs were made using CRS 338 that contained Ceres Clone 25429, Ceres Clone 41573, Ceres Clone 5750, Ceres Clone 218626, Ceres Clone 121021, Ceres Clone 158765, Ceres Clone 16403, Ceres Clone 19244, Ceres Clone 28635, Ceres Clone 35698, Ceres Clone 36412, Ceres Clone 368, Ceres Clone 41046, Ceres Clone 4829, Ceres Clone 5426, Ceres Clone 7894, or Ceres Clone 8161, each operably linked to a CaMV 35S promoter. Wild-type *Arabidopsis thaliana* ecotype Wassilewskija (Ws) plants were transformed separately with each construct. The transformations were performed essentially as described in Bechtold et al., C. R. *Acad. Sci. Paris,* 316:1194-1199 (1993).

Transgenic *Arabidopsis* lines containing Ceres Clone 25429, Ceres Clone 41573, Ceres Clone 5750, Ceres Clone 218626, Ceres Clone 5426, Ceres Clone 35698, Ceres Clone 4829, Ceres Clone 28635, Ceres Clone 16403, Ceres Clone 41046, Ceres Clone 19244, Ceres Clone 7894, Ceres Clone 158765, Ceres Clone 121021, Ceres Clone 36412, Ceres Clone 8161, or Ceres Clone 368 were designated ME01597, ME01720, ME01833, ME02065, ME01902, ME00072, ME00085, ME00147, ME00896, ME00900, ME00913, ME01704, ME02505, ME02525, ME00902, ME00914, or ME01754, respectively. The presence of each vector containing a Ceres clone described above in the respective transgenic *Arabidopsis* line transformed with the vector was confirmed by Finale™ resistance, polymerase chain reaction (PCR) amplification from green leaf tissue extract, and/or sequencing of PCR products. As controls, wild-type *Arabidopsis* ecotype Ws plants were transformed with the empty vector CRS 338.

The physical appearances of $T_1$ plants from ten events each of ME01597 and ME01720 were similar to those of corresponding control plants. The physical appearances of $T_1$ plants from nine out of ten events of ME01833 were comparable to those of the controls. Event-08 of ME01833 was taller and had reduced fertility compared to control plants. Event-08 of ME02065 also had reduced fertility compared to control plants. The physical appearances of $T_1$ plants from nine additional events of ME02065 were similar to those of corresponding control plants.

Example 2

Analysis of Oil Content in Transgenic *Arabidopsis* Seeds

An analytical method based on Fourier transform near-infrared (FT-NIR) spectroscopy was developed, validated, and used to perform a high-throughput screen of transgenic seed lines for alterations in seed oil content. To calibrate the FT-NIR spectroscopy method, a sub-population of transgenic seed lines was randomly selected and analyzed for oil content using a direct primary method. Fatty acid methyl ester (FAME) analysis by gas chromatography-mass spectroscopy (GC-MS) was used as the direct primary method to determine the total fatty acid content for each seed line and produce the FT-NIR spectroscopy calibration curves for oil.

To analyze seed oil content using GC-MS, seed tissue was homogenized in liquid nitrogen using a mortar and pestle to create a powder. The tissue was weighed, and 5.0±0.25 mg were transferred into a 2 mL Eppendorf tube. The exact weight of each sample was recorded. One mL of 2.5% $H_2SO_4$ (v/v in methanol) and 20 µL of undecanoic acid internal standard (1 mg/mL in hexane) were added to the weighed seed tissue. The tubes were incubated for two hours at 90° C. in a pre-equilibrated heating block. The samples were removed from the heating block and allowed to cool to room temperature. The contents of each Eppendorf tube were poured into a 15 mL polypropylene conical tube, and 1.5 mL of a 0.9% NaCl solution and 0.75 mL of hexane were added to each tube. The tubes were vortexed for 30 seconds and incubated at room temperature for 15 minutes. The samples were then centrifuged at 4,000 rpm for 5 minutes using a bench top centrifuge. If emulsions remained, then the centrifugation step was repeated until they were dissipated. One hundred µL of the hexane (top) layer was pipetted into a 1.5 mL autosampler vial with minimum volume insert. The samples were stored no longer than 1 week at −80° C. until they were analyzed.

Samples were analyzed using a Shimadzu QP-2010 GC-MS (Shimadzu Scientific Instruments, Columbia, Md.). The first and last sample of each batch consisted of a blank (hexane). Every fifth sample in the batch also consisted of a blank. Prior to sample analysis, a 7-point calibration curve was generated using the Supelco 37 component FAME mix (0.00004 mg/mL to 0.2 mg/mL). The injection volume was 1 µL.

The GC parameters were as follows: column oven temperature: 70° C., inject temperature: 230° C., inject mode: split, flow control mode: linear velocity, column flow: 1.0 mL/min, pressure: 53.5 mL/min, total flow: 29.0 mL/min, purge flow: 3.0 mL/min, split ratio: 25.0. The temperature gradient was as follows: 70° C. for 5 minutes, increasing to 350° C. at a rate of 5 degrees per minute, and then held at 350° C. for 1 minute. The MS parameters were as follows: ion source temperature: 200° C., interface temperature: 240° C., solvent cut time: 2 minutes, detector gain mode: relative, detector gain: 0.6 kV, threshold: 1000, group: 1, start time: 3 minutes, end time: 62 minutes, ACQ mode: scan, interval: 0.5 second, scan speed: 666 amu/sec., start M/z: 40, end M/z: 350. The instrument was tuned each time the column was cut or a new column was used.

The data were analyzed using the Shimadzu GC-MS Solutions software. Peak areas were integrated and exported to an Excel spreadsheet. Fatty acid peak areas were normalized to the internal standard, the amount of tissue weighed, and the slope of the corresponding calibration curve generated using the FAME mixture. Peak areas were also multiplied by the volume of hexane (0.75 mL) used to extract the fatty acids.

The same seed lines that were analyzed using GC-MS were also analyzed by FT-NIR spectroscopy, and the oil values determined by the GC-MS primary method were entered into the FT-NIR chemometrics software (Bruker Optics, Billerica, Mass.) to create a calibration curve for oil content. The actual oil content of each seed line analyzed using GC-MS was plotted on the x-axis of the calibration curve. The y-axis of the calibration curve represented the predicted values based on the best-fit line. Data points were continually added to the calibration curve data set.

$T_2$ seed from each transgenic plant line was analyzed by FT-NIR spectroscopy. Sarstedt tubes containing seeds were placed directly on the lamp, and spectra were acquired through the bottom of the tube. The spectra were analyzed to determine seed oil content using the FT-NIR chemometrics software (Bruker Optics) and the oil calibration curve. Results for experimental samples were compared to population means and standard deviations calculated for transgenic seed lines that were planted within 30 days of the lines being analyzed and grown under the same conditions. Typically, results from three to four events of each of 400 to 1600 different transgenic lines were used to calculate a population mean. Each data point was assigned a z-score (z=(x−mean)/std), and a p-value was calculated for the z-score.

Transgenic seed lines with oil levels in $T_2$ seed that differed by more than two standard deviations from the population mean were selected for evaluation of oil levels in the $T_3$ generation. All events of selected lines were planted in individual pots. The pots were arranged randomly in flats along with pots containing matched control plants in order to minimize microenvironment effects. Matched control plants contained an empty version of the vector used to generate the transgenic seed lines. $T_3$ seed from up to five plants from each event was collected and analyzed individually using FT-NIR spectroscopy. Data from replicate samples were averaged and compared to controls using the Student's t-test.

Example 3

Analysis of Protein Content in Transgenic *Arabidopsis* Seeds

An analytical method based on Fourier transform near-infrared (FT-NIR) spectroscopy was developed, validated, and used to perform a high-throughput screen of transgenic seed lines for alterations in seed protein content. To calibrate the FT-NIR spectroscopy method, total nitrogen elemental analysis was used as a primary method to analyze a sub-population of randomly selected transgenic seed lines. The overall percentage of nitrogen in each sample was determined. Percent nitrogen values were multiplied by a conversion factor to obtain percent total protein values. A conversion factor of 5.30 was selected based on data for cotton, sunflower, safflower, and sesame seed (Rhee, K. C., Determination of Total Nitrogen In Handbook of Food Analytical Chemistry—Water, Proteins, Enzymes, Lipids, and Carbohydrates (R. Wrolstad et al., ed.), John Wiley and Sons, Inc., p. 105, (2005)). The same seed lines were then analyzed by FT-NIR spectroscopy, and the protein values calculated via the primary method were entered into the FT-NIR chemometrics software (Bruker Optics, Billerica, Mass.) to create a calibration curve for analysis of seed protein content by FT-NIR spectroscopy.

Elemental analysis was performed using a FlashEA 1112 NC Analyzer (Thermo Finnigan, San Jose, Calif.). To analyze total nitrogen content, 2.00±0.15 mg of dried transgenic *Arabidopsis* seed was weighed into a tared tin cup. The tin cup with the seed was weighed, crushed, folded in half, and placed into an autosampler slot on the FlashEA 1112 NC Analyzer (Thermo Finnigan). Matched controls were prepared in a manner identical to the experimental samples and spaced evenly throughout the batch. The first three samples in every batch were a blank (empty tin cup), a bypass, (approximately 5 mg of aspartic acid), and a standard (5.00±0.15 mg aspartic acid), respectively. Blanks were entered between every 15 experimental samples. Each sample was analyzed in triplicate.

The FlashEA 1112 NC Analyzer (Thermo Finnigan) instrument parameters were as follows: left furnace 900° C., right furnace 840° C., oven 50° C., gas flow carrier 130 mL/min., and gas flow reference 100 mL/min. The data parameter LLOD was 0.25 mg for the standard and different for other materials. The data parameter LLOQ was 3.0 mg for the standard, 1.0 mg for seed tissue, and different for other materials.

Quantification was performed using the Eager 300 software (Thermo Finnigan). Replicate percent nitrogen measurements were averaged and multiplied by a conversion factor of 5.30 to obtain percent total protein values. For results to be considered valid, the standard deviation between replicate samples was required to be less than 10%. The percent nitrogen of the aspartic acid standard was required to be within ±1.0% of the theoretical value. For a run to be declared valid, the weight of the aspartic acid (standard) was required to be between 4.85 and 5.15 mg, and the blank(s) were required to have no recorded nitrogen content.

The same seed lines that were analyzed for elemental nitrogen content were also analyzed by FT-NR spectroscopy, and the percent total protein values determined by elemental analysis were entered into the FT-NIR chemometrics software (Bruker Optics, Billerica, Mass.) to create a calibration curve for protein content. The protein content of each seed line based on total nitrogen elemental analysis was plotted on the x-axis of the calibration curve. The y-axis of the calibration curve represented the predicted values based on the best-fit line. Data points were continually added to the calibration curve data set.

$T_2$ seed from each transgenic plant line was analyzed by FT-NIR spectroscopy. Sarstedt tubes containing seeds were placed directly on the lamp, and spectra were acquired through the bottom of the tube. The spectra were analyzed to determine seed protein content using the FT-NIR chemometrics software (Bruker Optics) and the protein calibration curve. Results for experimental samples were compared to population means and standard deviations calculated for transgenic seed lines that were planted within 30 days of the lines being analyzed and grown under the same conditions. Typically, results from three to four events of each of 400 to 1600 different transgenic lines were used to calculate a population mean. Each data point was assigned a z-score ($z=(x-mean)/std$), and a p-value was calculated for the z-score.

Transgenic seed lines with oil levels in $T_2$ seed that differed by more than two standard deviations from the population mean were also analyzed to determine protein levels in the $T_3$ generation. Events of selected lines were planted in individual pots. The pots were arranged randomly in flats along with pots containing matched control plants in order to minimize microenvironment effects. Matched control plants contained an empty version of the vector used to generate the transgenic seed lines. $T_3$ seed from up to five plants from each event was collected and analyzed individually using FT-NIR spectroscopy. Data from replicate samples were averaged and compared to controls using the Student's t-test.

Example 4

Results for ME01597 Events $T_2$ and $T_3$ seed from three events and four events, respectively, of ME01597 containing Ceres Clone 25429 was analyzed for oil content using FT-NIR spectroscopy as described in Example 2.

The oil content in $T_2$ seed from two events of ME01597 was significantly increased compared to the mean oil content in seed from transgenic *Arabidopsis* lines planted within 30 days of ME01597. As presented in Table 1, the oil content was increased to 123% and 124% in seed from events-03 and -06, respectively, compared to the population mean.

TABLE 1

| Oil content (% control) in $T_2$ and $T_3$ seed from ME01597 events containing Ceres Clone 25429 | | | | | |
|---|---|---|---|---|---|
| | Event - 01 | Event - 03 | Event - 06 | Event - 09 | Control |
| Oil content (% control) in $T_2$ seed | 101 | 123 | 124 | No data | 100 ± 11* |
| p-value** | 0.32 | 0.04 | 0.03 | No data | N/A |
| Oil content (% control) in $T_3$ seed | 106 ± 2 | 107 ± 4 | 107 ± 3 | 99 ± 4 | 100 ± 4 |

TABLE 1-continued

Oil content (% control) in $T_2$ and $T_3$ seed from ME01597 events containing Ceres Clone 25429

|  | Event - 01 | Event - 03 | Event - 06 | Event - 09 | Control |
|---|---|---|---|---|---|
| p-value*** | <0.01 | 0.05 | <0.01 | 0.70 | N/A |
| No. of $T_2$ plants | 5 | 4 | 4 | 5 | 31 |

*Population mean of the oil content of seed from transgenic lines planted within 30 days of ME01597. Variation is presented as the standard error of the mean.
**The p-values for $T_2$ seed were calculated using z-scores.
***The p-values for $T_3$ seed were calculated using a Student's t-test.

The oil content in $T_3$ seed from three events of ME01597 was significantly increased compared to the oil content of corresponding control seeds. As presented in Table 1, the oil content was increased to 106% in seed from event-01 and to 107% in seed from events-03 and -06 compared to the oil content in control seed.

$T_2$ and $T_3$ seed from three events and four events, respectively, of ME01597 containing Ceres Clone 25429 was also analyzed for protein content using FT-NIR spectroscopy as described in Example 3.

The protein content in $T_2$ seed from ME01597 events was not observed to differ significantly from the mean protein content in seed from transgenic *Arabidopsis* lines planted within 30 days of ME01597 (Table 2).

TABLE 2

Protein content (% control) in $T_2$ and $T_3$ seed from ME01597 events containing Ceres Clone 25429

|  | Event - 01 | Event - 03 | Event - 06 | Event - 09 | Control |
|---|---|---|---|---|---|
| Protein content (% control) in $T_2$ seed | 98 | 98 | 93 | No data | 100 ± 9* |
| p-value** | 0.40 | 0.29 | 0.27 | No data | N/A |
| Protein content (% control) in $T_3$ seed | 109 ± 2 | 110 ± 4 | 106 ± 7 | 110 ± 3 | 100 ± 5 |
| p-value*** | <0.01 | 0.01 | 0.15 | <0.01 | N/A |
| No. of $T_2$ plants | 5 | 4 | 4 | 5 | 31 |

*Population mean of the protein content in seed from transgenic lines planted within 30 days of ME01597. Variation is presented as the standard error of the mean.
**The p-values for $T_2$ seed were calculated using z-scores.
***The p-values for $T_3$ seed were calculated using a Student's t-test.

The protein content in $T_3$ seed from three events of ME01597 was significantly increased compared to the protein content in corresponding control seed. As presented in Table 2, the protein content was increased to 109% in seed from event-01 and to 110% in seed from events-03 and -09 compared to the protein content in control seed.

There were no observable or statistically significant differences between $T_2$ ME01597 and control plants in germination, onset of flowering, rosette area, fertility, and general morphology/architecture.

Example 5

Results for ME01720 Events $T_2$ and $T_3$ seed from five events of ME01720 containing Ceres Clone 41573 was analyzed for oil content using FT-NIR spectroscopy as described in Example 2.

The oil content in $T_2$ seed from three events of ME01720 was significantly increased compared to the mean oil content in seed from transgenic *Arabidopsis* lines planted within 30 days of ME01720. As presented in Table 3, the oil content was increased to 123% in seed from events-01 and -03 and to 130% in seed from event-06 compared to the population mean.

TABLE 3

Oil content (% control) in $T_2$ and $T_3$ seed from ME01720 events containing Ceres Clone 41573

|  | Event - 01 | Event - 02 | Event - 03 | Event - 04 | Event - 06 | Control |
|---|---|---|---|---|---|---|
| Oil content (% control) in $T_2$ seed | 123 | 98 | 123 | 112 | 130 | 100 ± 11* |
| p-value** | 0.04 | 0.31 | 0.04 | 0.18 | 0.01 | N/A |
| Oil content (% control) in $T_3$ seed | 105 ± 3 | 100 ± 3 | 108 ± 1 | 99 ± 1 | 105 ± 2 | 100 ± 4 |
| p-value*** | 0.01 | 1.00 | <0.01 | 0.60 | 0.04 | N/A |
| No. of $T_2$ plants | 5 | 5 | 4 | 3 | 3 | 31 |

*Population mean of the oil content in seed from transgenic lines planted within 30 days of ME01720. Variation is presented as the standard error of the mean.
**The p-values for $T_2$ seed were calculated using z-scores.
***The p-values for $T_3$ seed were calculated using a Student's t-test.

The oil content in $T_3$ seed from three events of ME01720 was significantly increased compared to the oil content in corresponding control seeds. As presented in Table 3, the oil content was increased to 105% in seed from events-01 and -06 and to 108% in seed from event-03 compared to the oil content in control seed.

$T_2$ and $T_3$ seed from five events of ME01720 containing Ceres Clone 41573 was also analyzed for total protein content using FT-NIR spectroscopy as described in Example 3.

The protein content in $T_2$ seed from ME01720 events was not observed to differ significantly from the mean protein content in seed from transgenic *Arabidopsis* lines planted within 30 days of ME01720 (Table 4).

TABLE 4

Protein content (% control) in $T_2$ and $T_3$ seed from ME01720 events containing Ceres Clone 41573

|  | Event - 01 | Event - 02 | Event - 03 | Event - 04 | Event - 06 | Control |
|---|---|---|---|---|---|---|
| Protein content (% control) in $T_2$ seed | 92 | 103 | 89 | 96 | 84 | 100 ± 8* |
| p-value** | 0.24 | 0.40 | 0.15 | 0.36 | 0.06 | N/A |
| Protein content (% control) in $T_3$ seed | 107 ± 2 | 114 ± 3 | 106 ± 5 | 107 ± 0 | 106 ± 2 | 100 ± 5 |
| p-value*** | <0.01 | <0.01 | 0.07 | <0.01 | 0.01 | N/A |
| No. of $T_2$ plants | 5 | 5 | 4 | 3 | 3 | 31 |

*Population mean of the protein content in seed from transgenic lines planted within 30 days of ME01720. Variation is presented as the standard error of the mean.
**The p-values for $T_2$ seed were calculated using z-scores.
***The p-values for $T_3$ seed were calculated using a Student's t-test.

The protein content in $T_3$ seed from four events of ME01720 was significantly increased compared to the protein content in corresponding control seed. As presented in Table 4, the protein content was increased to 107%, 114%, 107%, and 106% in events-01, -02, -04, and -06, respectively, compared to the protein content in control seed.

There were no observable or statistically significant differences between $T_2$ ME01720 and control plants in germination, onset of flowering, rosette area, and fertility. The general morphology/architecture of the plants appeared wild-type in all instances except for event-01, which had a small (<30%), but statistically significant (p<0.05), change in plant size.

Example 6

Results for ME01833 Events $T_2$ and $T_3$ seed from four events of ME01833 containing Ceres Clone 5750 was analyzed for oil content using FT-NIR spectroscopy as described in Example 2.

The oil content in $T_2$ seed from four events of ME01833 was significantly increased compared to the mean oil content in seed from transgenic *Arabidopsis* lines planted within 30 days of ME01833. As presented in Table 5, the oil content was increased to 135%, 138%, 143%, and 172% in seed from events-01, -02, -03, and -04, respectively, compared to the population mean.

TABLE 5

Oil content (% control) in $T_2$ and $T_3$ seed from ME01833 events containing Ceres Clone 5750

| | Event - 01 | Event - 02 | Event - 03 | Event - 04 | Control |
|---|---|---|---|---|---|
| Oil content (% control) in $T_2$ seed | 135 | 138 | 143 | 172 | 100 ± 11* |
| p-value** | <0.01 | <0.01 | <0.01 | <0.01 | N/A |
| Oil content (% control) in $T_3$ seed | 95 ± 4 | 102 ± 4 | 105 ± 1 | 112 ± 1 | 100 ± 4 |
| p-value*** | 0.08 | 0.35 | <0.01 | <0.01 | N/A |
| No. of $T_2$ plants | 4 | 4 | 3 | 4 | 31 |

*Population mean of the oil content in seed from transgenic lines planted within 30 days of ME01833. Variation is presented as the standard error of the mean.
**The p-values for $T_2$ seed were calculated using z-scores.
***The p-values for $T_3$ seed were calculated using a Student's t-test.

The oil content in $T_3$ seed from two events of ME01833 was significantly increased compared to the oil content in corresponding control seed. As presented in Table 5, the oil content was increased to 105% and 112% in seed from events-03 and -04, respectively, compared to the oil content in control seed.

$T_2$ and $T_3$ seed from four events of ME01833 containing Ceres Clone 5750 was also analyzed for total protein content using FT-NIR spectroscopy as described in Example 3.

The protein content in $T_2$ seed from one event of ME01833 was significantly increased compared to the mean protein content in seed from transgenic *Arabidopsis* lines planted within 30 days of ME01833. As presented in Table 6, the protein content was increased to 123% in event-04 compared to the population mean.

TABLE 6

Protein content (% control) in $T_2$ and $T_3$ seed from ME01833 events containing Ceres Clone 5750

| | Event - 01 | Event - 02 | Event - 03 | Event - 04 | Control |
|---|---|---|---|---|---|
| Protein content (% control) in $T_2$ seed | 94 | 101 | 98 | 123 | 100 ± 8* |
| p-value** | 0.32 | 0.41 | 0.40 | 0.01 | N/A |
| Protein content (% control) in $T_3$ seed | 109 ± 8 | 102 ± 3 | 99 ± 1 | 112 ± 5 | 100 ± 4 |
| p-value*** | 0.11 | 0.28 | 0.28 | 0.02 | N/A |
| No. of $T_2$ plants | 4 | 4 | 3 | 4 | 31 |

*Population mean of the protein content in seed from transgenic lines planted within 30 days of ME01833. Variation is presented as the standard error of the mean.
**The p-values for $T_2$ seed were calculated using z-scores.
***The p-values for $T_3$ seed were calculated using a Student's t-test.

The protein content in $T_3$ seed from one event of ME01833 was significantly increased compared to the protein content in corresponding control seed. As presented in Table 6, the protein content was increased to 112% in seed from event-04 compared to the protein content in control seed.

There were no observable or statistically significant differences between $T_2$ ME01833 and control plants in germination, onset of flowering, rosette area, fertility, and general morphology/architecture.

Example 7

Results for ME02065 Events $T_2$ and $T_3$ seed from four events of ME02065 containing Ceres Clone 218626 was analyzed for oil content using FT-NIR spectroscopy as described in Example 2.

The oil content in $T_2$ seed from three events of ME02065 was significantly increased compared to the mean oil content in seed from transgenic *Arabidopsis* lines planted within 30 days of ME02065. As presented in Table 7, the oil content was increased to 123%, 132%, and 145% in seed from events-01, -04, and -05, respectively, compared to the population mean.

TABLE 7

Oil content (% control) in $T_2$ and $T_3$ seed from ME02065 events containing Ceres Clone 218626

| | Event - 01 | Event - 02 | Event - 04 | Event - 05 | Control |
|---|---|---|---|---|---|
| Oil content (% control) in $T_2$ seed | 123 | 115 | 132 | 145 | 100 ± 11* |
| p-value** | 0.04 | 0.13 | <0.01 | <0.01 | N/A |
| Oil content (% control) in $T_3$ seed | 109 ± 4 | 103 ± 1 | 112 ± 1 | 102 ± 5 | 100 ± 4 |
| p-value*** | 0.01 | 0.05 | <0.01 | 0.46 | N/A |
| No. of $T_2$ plants | 4 | 2 | 5 | 4 | 31 |

*Population mean of the oil content in seed from transgenic lines planted within 30 days of ME02065. Variation is presented as the standard error of the mean.
**The p-values for $T_2$ seed were calculated using z-scores.
***The p-values for $T_3$ seed were calculated using a Student's t-test.

The oil content in $T_3$ seed from three events of ME02065 was significantly increased compared to the oil content in corresponding control seed. As presented in Table 7, the oil content was increased to 109%, 103%, and 112% in seed from events-01, -02, and -04, respectively, compared to the oil content in control seed.

$T_2$ and $T_3$ seed from four events of ME02065 containing Ceres Clone 218626 was also analyzed for total protein content using FT-NIR spectroscopy as described in Example 3.

The protein content in $T_2$ seed from ME02065 events was not observed to differ significantly from the mean protein content in seed from transgenic *Arabidopsis* lines planted within 30 days of ME02065 (Table 8).

TABLE 8

Protein content (% control) in $T_2$ and $T_3$ seed from ME02065 events containing Ceres Clone 218626

|  | Event - 01 | Event - 02 | Event - 04 | Event - 05 | Control |
|---|---|---|---|---|---|
| Protein content (% control) in $T_2$ seed | 103 | 104 | 104 | 105 | 100 ± 8* |
| p-value** | 0.39 | 0.37 | 0.37 | 0.34 | N/A |
| Protein content (% control) in $T_3$ seed | 105 ± 3 | 110 ± 1 | 109 ± 2 | 113 ± 4 | 100 ± 5 |
| p-value*** | 0.01 | <0.01 | <0.01 | <0.01 | N/A |
| No. of $T_2$ plants | 4 | 2 | 5 | 4 | 31 |

*Population mean of the protein content in seed from transgenic lines planted within 30 days of ME02065. Variation is presented as the standard error of the mean.
**The p-values for $T_2$ seed were calculated using z-scores.
***The p-values for $T_3$ seed were calculated using a Student's t-test.

The protein content in $T_3$ seed from four events of ME02065 was significantly increased compared to the protein content in corresponding control seed. As presented in Table 8, the protein content was increased to 105%, 110%, 109%, and 113% in seed from events-01, -02, -04, and -05, respectively, compared to the protein content in control seed.

There were no observable or statistically significant differences between $T_2$ ME02065 and control plants in germination, onset of flowering, rosette area, fertility, and general morphology/architecture.

Example 8

Results for ME01902 Events $T_2$ and $T_3$ seed from five events and four events, respectively, of ME01902 containing Ceres Clone 5426 was analyzed for oil content using FT-NIR spectroscopy as described in Example 2.

The oil content in $T_2$ seed from three events of ME01902 was significantly increased compared to the mean oil content in seed from transgenic *Arabidopsis* lines planted within 30 days of ME01902. As presented in Table 9, the oil content was increased to 118%, 125%, and 124% in seed from events-02, -04, and -07, respectively, compared to the population mean.

TABLE 9

Oil content (% control) in $T_2$ and $T_3$ seed from ME01902 events containing Ceres Clone 5426

|  | Event - 01 | Event - 02 | Event - 03 | Event - 04 | Event - 07 | Control |
|---|---|---|---|---|---|---|
| Oil content (% control) in $T_2$ seed | 102 | 118 | 107 | 125 | 124 | 100* |
| p-value** | 0.17 | 0.03 | 0.14 | 0.01 | 0.01 | N/A |
| Oil content (% control) in $T_3$ seed | No data | 108 ± 4 | 103 ± 1 | 104 ± 4 | 109 ± 5 | 100 |
| p-value*** | No data | 0.02 | <0.01 | 0.10 | 0.03 | N/A |

*Population mean of the oil content in seed from transgenic lines planted within 30 days of ME01902. Variation is presented as the standard error of the mean.
**The p-values for $T_2$ seed were calculated using z-scores.
***The p-values for $T_3$ seed were calculated using a Student's t-test.

The oil content in $T_3$ seed from three events of ME01902 was significantly increased compared to the oil content in corresponding control seed. As presented in Table 9, the oil content was increased to 108%, 103%, and 109% in seed from events-02, -03, and -07, respectively, compared to the oil content in control seed.

$T_2$ and $T_3$ seed from five events and four events, respectively, of ME01902 containing Ceres Clone 5426 was also analyzed for total protein content using FT-NIR spectroscopy as described in Example 3.

The protein content in $T_2$ seed from ME01902 events was not observed to differ significantly from the mean protein content in seed from transgenic *Arabidopsis* lines planted within 30 days of ME01902 (Table 10).

TABLE 10

Protein content (% control) in $T_2$ and $T_3$ seed from ME01902 events containing Ceres Clone 5426

|  | Event - 01 | Event - 02 | Event - 03 | Event - 04 | Event - 07 | Control |
|---|---|---|---|---|---|---|
| Protein content (% control) in $T_2$ seed | 99 | 106 | 90 | 93 | 96 | 100* |
| p-value** | 0.26 | 0.18 | 0.08 | 0.15 | 0.22 | N/A |
| Protein content (% control) in $T_3$ seed | No data | 116 ± 4 | 113 | 118 ± 2 | 111 ± 1 | 100 ± 1 |
| p-value*** | No data | 0.02 | <0.01 | <0.01 | <0.01 | N/A |

*Population mean of the protein content in seed from transgenic lines planted within 30 days of ME01902. Variation is presented as the standard error of the mean.
**The p-values for $T_2$ seed were calculated using z-scores.
***The p-values for $T_3$ seed were calculated using a Student's t-test.

The protein content in $T_3$ seed from four events of ME01902 was significantly increased compared to the protein content in corresponding control seed. As presented in Table 10, the protein content was increased to 116%, 113%, 118%, and 111% in seed from events-02, -03, -04, and -07, respectively, compared to the protein content in control seed.

Example 9

Results for ME00072 Events $T_2$ and $T_3$ seed from seven events and five events, respectively, of ME00072 containing Ceres Clone 35698 was analyzed for oil content using FT-NIR spectroscopy as described in Example 2.

The oil content in $T_2$ seed from three events of ME00072 was significantly increased compared to the mean oil content in seed from transgenic *Arabidopsis* lines planted within 30 days of ME00072. As presented in Table 11, the oil content was increased to 115%, 121%, and 117% in seed from events-02, -03, and -06, respectively, compared to the population mean.

TABLE 11

Oil content (% control) in $T_2$ and $T_3$ seed from ME00072 events containing Ceres Clone 35698

| | Event-02 | Event-03 | Event-05 | Event-06 | Event-07 | Event-08 | Event-09 | Control |
|---|---|---|---|---|---|---|---|---|
| Oil content (% control) in $T_2$ seed | 115 | 121 | 109 | 117 | 104 | 107 | 102 | 100 ± 12* |
| p-value** | 0.04 | 0.01 | 0.11 | 0.02 | 0.17 | 0.14 | 0.19 | N/A |
| Oil content (% control) in $T_3$ seed | 100 ± 1 | 102 ± 2 | 101 ± 4 | 105 ± 1 | 101 ± 2 | No data | No data | 100 ± 4 |
| p-value** | 0.72 | 0.18 | 0.79 | 0.01 | 0.60 | No data | No data | N/A |

*Population mean of the oil content in seed from transgenic lines planted within 30 days of ME00072. Variation is presented as the standard error of the mean.
**The p-values for $T_2$ seed were calculated using z-scores.
***The p-values for $T_3$ seed were calculated using a Student's t-test.

The oil content in $T_3$ seed from one event of ME00072 was significantly increased compared to the oil content in corresponding control seed. As presented in Table 11, the oil content was increased to 105% in seed from event-06 compared to the oil content in control seed.

Example 10

Results for ME00085 Events $T_2$ and $T_3$ seed from six events and four events, respectively, of ME00085 containing Ceres Clone 4829 was analyzed for oil content using FT-NIR spectroscopy as described in Example 2.

The oil content in $T_2$ seed from two events of ME00085 was significantly increased compared to the mean oil content in seed from transgenic *Arabidopsis* lines planted within 30 days of ME00085. As presented in Table 12, the oil content was increased to 120% and 117% in seed from events-01 and -02, respectively, compared to the population mean.

The oil content in $T_3$ seed from two events of ME00085 was significantly increased compared to the oil content in corresponding control seed. As presented in Table 12, the oil content was increased to 111% in seed from events-02 and -03 compared to the oil content in control seed.

Example 11

Results for ME00147 Events $T_2$ and $T_3$ seed from seven events and five events, respectively, of ME00147 containing Ceres Clone 28635 was analyzed for oil content using FT-NIR spectroscopy as described in Example 2.

The oil content in $T_2$ seed from three events of ME00147 was significantly increased compared to the mean oil content in seed from transgenic *Arabidopsis* lines planted within 30 days of ME00147. As presented in Table 13, the oil content was increased to 119%, 120%, and 118% in seed from events-02, -03, and -04, respectively, compared to the population mean.

TABLE 12

Oil content (% control) in $T_2$ and $T_3$ seed from ME00085 events containing Ceres Clone 4829

| | Event-01 | Event-02 | Event-03 | Event-04 | Event-05 | Event-06 | Control |
|---|---|---|---|---|---|---|---|
| Oil content (% control) in $T_2$ seed | 120 | 117 | 92 | 98 | 100 | 109 | 100 ± 12* |
| p-value** | 0.01 | 0.03 | 0.13 | 0.19 | 0.19 | 0.11 | N/A |
| Oil content (% control) in $T_3$ seed | 95 ± 4 | 111 ± 2 | 111 ± 2 | 104 ± 4 | No data | No data | 100 ± 4 |
| p-value*** | 0.20 | <0.01 | <0.01 | 0.09 | No data | No data | N/A |

*Population mean of the oil content in seed from transgenic lines planted within 30 days of ME00085. Variation is presented as the standard error of the mean.
**The p-values for $T_2$ seed were calculated using z-scores.
***The p-values for $T_3$ seed were calculated using a Student's t-test.

TABLE 13

Oil content (% control) in $T_2$ and $T_3$ seed from ME00147 events containing Ceres Clone 28635

|  | Event - 02 | Event - 03 | Event - 04 | Event - 05 | Event - 06 | Event - 07 | Event - 08 | Event - 09 | Control |
|---|---|---|---|---|---|---|---|---|---|
| Oil content (% control) in $T_2$ seed | 119 | 120 | 118 | No data | 95 | 108 | 105 | 102 | 100 ± 12* |
| p-value** | 0.02 | 0.01 | 0.02 | No data | 0.16 | 0.13 | 0.16 | 0.19 | N/A |
| Oil content (% control) in $T_3$ seed | 102 ± 2 | 101 ± 0 | 105 ± 2 | 99 ± 2 | 97 ± 4 | No data | No data | No data | 100 ± 4 |
| p-value*** | 0.15 | 0.47 | 0.04 | 0.52 | 0.21 | No data | No data | No data | N/A |

*Population mean of the oil content in seed from transgenic lines planted within 30 days of ME00147. Variation is presented as the standard error of the mean.
**The p-values for $T_2$ seed were calculated using z-scores.
***The p-values for $T_3$ seed were calculated using a Student's t-test.

The oil content in $T_3$ seed from one event of ME00147 was significantly increased compared to the oil content in corresponding control seed. As presented in Table 13, the oil content was increased to 105% in seed from event-04 compared to the oil content in control seed.

Example 12

Results for ME00896 Events $T_2$ and $T_3$ seed from three events and four events, respectively, of ME00896 containing Ceres Clone 16403 was analyzed for oil content using FT-NIR spectroscopy as described in Example 2.

The oil content in $T_2$ seed from three events of ME00896 was significantly increased compared to the mean oil content in seed from transgenic *Arabidopsis* lines planted within 30 days of ME00896. As presented in Table 14, the oil content was increased to 130%, 126%, and 118% in seed from events-03, -04, and -05, respectively, compared to the population mean.

TABLE 14

Oil content (% control) in $T_2$ and $T_3$ seed from ME00896 events containing Ceres Clone 16403

|  | Event -02 | Event -03 | Event -04 | Event -05 | Control |
|---|---|---|---|---|---|
| Oil content (% control) in $T_2$ seed | No data | 130 | 126 | 118 | 100 ± 10* |
| p-value** | No data | 0.01 | 0.02 | 0.05 | N/A |
| Oil content (% control) in $T_3$ seed | 102 ± 2 | 100 ± 1 | 104 ± 2 | 100 ± 1 | 100 ± 4 |
| p-value*** | 0.09 | 0.91 | 0.03 | 0.93 | N/A |

*Population mean of the oil content in seed from transgenic lines planted within 30 days of ME00896. Variation is presented as the standard error of the mean.
**The p-values for $T_2$ seed were calculated using z-scores.
***The p-values for $T_3$ seed were calculated using a Student's t-test.

The oil content in $T_3$ seed from one event of ME00896 was significantly increased compared to the oil content in corresponding control seed. As presented in Table 14, the oil content was increased to 104% in seed from event-04 compared to the oil content in control seed.

Example 13

Results for ME00900 Events $T_2$ and $T_3$ seed from three events and two events, respectively, of ME00900 containing Ceres Clone 41046 was analyzed for oil content using FT-NIR spectroscopy as described in Example 2.

The oil content in $T_2$ seed from two events of ME00900 was significantly increased compared to the mean oil content in seed from transgenic *Arabidopsis* lines planted within 30 days of ME00900. As presented in Table 15, the oil content was increased to 132% and 128% in seed from events-01 and -02, respectively, compared to the population mean.

TABLE 15

Oil content (% control) in $T_2$ and $T_3$ seed from ME00900 events containing Ceres Clone 41046

|  | Event -01 | Event -02 | Event -03 | Control |
|---|---|---|---|---|
| Oil content (% control) in $T_2$ seed | 132 | 128 | 108 | 100 ± 10* |
| p-value** | 0.01 | 0.01 | 0.11 | N/A |
| Oil content (% control) in $T_3$ seed | 105 ± 3 | No data | 97 ± 2 | 100 ± 4 |
| p-value*** | 0.01 | No data | 0.06 | N/A |

*Population mean of the oil content in seed from transgenic lines planted within 30 days of ME00900. Variation is presented as the standard error of the mean.
**The p-values for $T_2$ seed were calculated using z-scores.
***The p-values for $T_3$ seed were calculated using a Student's t-test.

The oil content in $T_3$ seed from one event of ME00900 was significantly increased compared to the oil content in corresponding control seed. As presented in Table 15, the oil content was increased to 105% in seed from event-01 compared to the oil content in control seed.

Example 14

Results for ME00913 Events $T_2$ and $T_3$ seed from four events of ME00913 containing Ceres Clone 19244 was analyzed for oil content using FT-NIR spectroscopy as described in Example 2.

The oil content in $T_2$ seed from two events of ME00913 was significantly increased compared to the mean oil content in seed from transgenic *Arabidopsis* lines planted within 30 days of ME00913. As presented in Table 16, the oil content was increased to 130% and 128% in seed from events-01 and -04, respectively, compared to the population mean.

TABLE 16

Oil content (% control) in $T_2$ and $T_3$ seed from ME00913 events containing Ceres Clone 19244

|  | Event -01 | Event -02 | Event -03 | Event -04 | Control |
|---|---|---|---|---|---|
| Oil content (% control) in $T_2$ seed | 130 | 114 | 91 | 128 | 100 ± 10* |
| p-value** | 0.01 | 0.08 | 0.11 | 0.01 | N/A |
| Oil content (% control) in $T_3$ seed | 99 ± 5 | 107 ± 0 | 104 ± 2 | 106 ± 4 | 100 ± 4 |
| p-value*** | 0.91 | <0.01 | 0.01 | 0.02 | N/A |

*Population mean of the oil content in seed from transgenic lines planted within 30 days of ME00913. Variation is presented as the standard error of the mean.
**The p-values for $T_2$ seed were calculated using z-scores.
***The p-values for $T_3$ seed were calculated using a Student's t-test.

The oil content in $T_3$ seed from three events of ME00913 was significantly increased compared to the oil content in corresponding control seed. As presented in Table 16, the oil content was increased to 107%, 104%, and 106% in seed from events-02, -03, and -04, respectively, compared to the oil content in control seed.

Example 15

Results for ME01704 Events $T_2$ and $T_3$ seed from four events and five events, respectively, of ME01704 containing Ceres Clone 7894 was analyzed for oil content using FT-NIR spectroscopy as described in Example 2.

The oil content in $T_2$ seed from three events of ME01704 was significantly increased compared to the mean oil content in seed from transgenic *Arabidopsis* lines planted within 30 days of ME01704. As presented in Table 17, the oil content was increased to 126%, 118%, and 132% in seed from events-02, -04, and -06, respectively, compared to the population mean.

TABLE 17

Oil content (% control) in $T_2$ and $T_3$ seed from ME01704 events containing Ceres Clone 7894

|  | Event -01 | Event -02 | Event -03 | Event -04 | Event -06 | Control |
|---|---|---|---|---|---|---|
| Oil content (% control) in $T_2$ seed | 103 | 126 | No data | 118 | 132 | 100 ± 9* |
| p-value** | 0.17 | 0.01 | No data | 0.04 | <0.01 | N/A |
| Oil content (% control) in $T_3$ seed | 101 ± 1 | 103 ± 2 | 97 ± 6 | 109 ± 3 | 107 ± 3 | 100 ± 4 |
| p-value*** | 0.60 | 0.12 | 0.49 | <0.01 | <0.01 | N/A |

*Population mean of the oil content in seed from transgenic lines planted within 30 days of ME01704. Variation is presented as the standard error of the mean.
**The p-values for $T_2$ seed were calculated using z-scores.
***The p-values for $T_3$ seed were calculated using a Student's t-test.

The oil content in $T_3$ seed from two events of ME01704 was significantly increased compared to the oil content in corresponding control seed. As presented in Table 17, the oil content was increased to 109% and 107% in seed from events-04 and -06, respectively, compared to the oil content in control seed.

Example 16

Results for ME02505 Events $T_2$ and $T_3$ seed from five events of ME02505 containing Ceres Clone 158765 was analyzed for oil content using FT-NIR spectroscopy as described in Example 2.

The oil content in $T_2$ seed from three events of ME02505 was significantly increased compared to the mean oil content in seed from transgenic *Arabidopsis* lines planted within 30 days of ME02505. As presented in Table 18, the oil content was increased to 120%, 129%, and 140% in seed from events-01, -02, and -03, respectively, compared to the population mean.

TABLE 18

Oil content (% control) in $T_2$ and $T_3$ seed from ME02505 events containing Ceres Clone 158765

|  | Event -01 | Event -02 | Event -03 | Event -04 | Event -05 | Control |
|---|---|---|---|---|---|---|
| Oil content (% control) in $T_2$ seed | 120 | 129 | 140 | 104 | 105 | 100 ± 11* |
| p-value** | 0.02 | <0.01 | <0.01 | 0.19 | 0.19 | N/A |
| Oil content (% control) in $T_3$ seed | 101 ± 1 | 100 ± 1 | 103 ± 1 | 108 ± 1 | 105 ± 2 | 100 + 4 |
| p-value*** | 0.47 | 0.79 | 0.01 | <0.01 | 0.02 | N/A |

*Population mean of the oil content in seed from transgenic lines planted within 30 days of ME02505. Variation is presented as the standard error of the mean.
**The p-values for $T_2$ seed were calculated using z-scores.
***The p-values for $T_3$ seed were calculated using a Student's t-test.

The oil content in $T_3$ seed from three events of ME02505 was significantly increased compared to the oil content in corresponding control seed. As presented in Table 18, the oil content was increased to 103%, 108%, and 105% in seed from events-03, -04, and -05, respectively, compared to the oil content in control seed.

Example 17

Results for ME02525 Events $T_2$ and $T_3$ seed from four events of ME02525 containing Ceres Clone 121021 was analyzed for oil content using FT-NIR spectroscopy as described in Example 2.

The oil content in $T_2$ seed from two events of ME02525 was significantly increased compared to the mean oil content in seed from transgenic *Arabidopsis* lines planted within 30 days of ME02525. As presented in Table 19, the oil content was increased to 134% and 145% in seed from events-01 and -02, respectively, compared to the population mean.

TABLE 19

Oil content (% control) in $T_2$ and $T_3$ seed from ME02525 events containing Ceres Clone 121021

|  | Event-01 | Event-02 | Event-03 | Event-04 | Event-07 | Control |
|---|---|---|---|---|---|---|
| Oil content (% control) in $T_2$ seed | 134 | 145 | 113 | No data | 103 | 100 ± 11* |
| p-value** | <0.01 | <0.01 | 0.09 | No data | 0.20 | N/A |
| Oil content (% control) in $T_3$ seed | 102 ± 2 | 99 ± 1 | 98 ± 1 | 103 ± 2 | No data | 100 ± 4 |
| p-value*** | 0.19 | 0.16 | 0.10 | 0.05 | No data | N/A |

*Population mean of the oil content in seed from transgenic lines planted within 30 days of ME02525. Variation is presented as the standard error of the mean.
**The p-values for $T_2$ seed were calculated using z-scores.
***The p-values for $T_3$ seed were calculated using a Student's t-test.

The oil content in $T_3$ seed from one event of ME02525 was significantly increased compared to the oil content in corresponding control seed. As presented in Table 19, the oil content was increased to 103% in seed from event-04 compared to the oil content in control seed.

Example 18

Results for ME00902 Events $T_2$ and $T_3$ seed from four events of ME00902 containing Ceres Clone 36412 was analyzed for oil content using FT-NIR spectroscopy as described in Example 2.

The oil content in $T_2$ seed from ME00902 events was not observed to differ significantly from the mean oil content in seed from transgenic *Arabidopsis* lines planted within 30 days of ME00902 (Table 20).

TABLE 20

Oil content (% control) in $T_2$ and $T_3$ seed from ME00902 events containing Ceres Clone 36412

|  | Event-01 | Event-03 | Event-04 | Event-05 | Control |
|---|---|---|---|---|---|
| Oil content (% control) in $T_2$ seed | 115 | 114 | 114 | 113 | 100 ± 10* |
| p-value** | 0.07 | 0.07 | 0.08 | 0.08 | N/A |

TABLE 20-continued

Oil content (% control) in $T_2$ and $T_3$ seed from ME00902 events containing Ceres Clone 36412

|  | Event-01 | Event-03 | Event-04 | Event-05 | Control |
|---|---|---|---|---|---|
| Oil content (% control) in $T_3$ seed | 104 ± 1 | 98 ± 1 | 102 ± 1 | 103 ± 3 | 100 ± 4 |
| p-value*** | <0.01 | 0.04 | 0.09 | 0.12 | N/A |

*Population mean of the oil content in seed from transgenic lines planted within 30 days of ME00902. Variation is presented as the standard error of the mean.
**The p-values for $T_2$ seed were calculated using z-scores.
***The p-values for $T_3$ seed were calculated using a Student's t-test.

The oil content in $T_3$ seed from one event of ME00902 was significantly increased compared to the oil content in corresponding control seed. As presented in Table 20, the oil content was increased to 104% in seed from event-01 compared to the oil content in control seed. The oil content in $T_3$ seed from one event of ME00902 was significantly decreased compared to the oil content in corresponding control seed. As presented in Table 20, the oil content was decreased to 98% in seed from event-03 compared to the oil content in control seed.

Example 19

Results for ME00914 Events $T_2$ and $T_3$ seed from five events and four events, respectively, of ME00914 containing Ceres Clone 8161 was analyzed for oil content using FT-NIR spectroscopy as described in Example 2.

The oil content in $T_2$ seed from four events of ME00914 was significantly increased compared to the mean oil content in seed from transgenic *Arabidopsis* lines planted within 30 days of ME00914. As presented in Table 21, the oil content was increased to 121%, 122%, 125%, and 129% in seed from events-01, -02, -03, and -05, respectively, compared to the population mean.

TABLE 21

Oil content (% control) in $T_2$ and $T_3$ seed from ME00914 events containing Ceres Clone 8161

|  | Event-01 | Event-02 | Event-03 | Event-04 | Event-05 | Control |
|---|---|---|---|---|---|---|
| Oil content (% control) in $T_2$ seed | 121 | 122 | 125 | 116 | 129 | 100 ± 10* |
| p-value** | 0.04 | 0.03 | 0.02 | 0.06 | 0.01 | N/A |
| Oil content (% control) in $T_3$ seed | 101 ± 0 | 98 ± 1 | 98 ± 2 | No data | 107 ± 1 | 100 ± 4 |
| p-value*** | 0.46 | <0.01 | 0.05 | No data | <0.01 | N/A |

*Population mean of the oil content in seed from transgenic lines planted within 30 days of ME00914. Variation is presented as the standard error of the mean.
**The p-values for $T_2$ seed were calculated using z-scores.
***The p-values for $T_3$ seed were calculated using a Student's t-test.

The oil content in $T_3$ seed from one event of ME00914 was significantly increased compared to the oil content in corresponding control seed. As presented in Table 21, the oil content was increased to 107% in seed from event-05 compared to the oil content in control seed. The oil content in $T_3$ seed from two events of ME00914 was significantly decreased compared to the oil content in corresponding control seed. As presented in Table 21, the oil content was decreased to 98% in seed from events-02 and -03 compared to the oil content in control seed.

Example 20

Results for ME01754 Events $T_2$ and $T_3$ seed from five events and four events, respectively, of ME01754 containing Ceres Clone 368 was analyzed for oil content using FT-NIR spectroscopy as described in Example 2.

The oil content in $T_2$ seed from two events of ME01754 was significantly increased compared to the mean oil content in seed from transgenic *Arabidopsis* lines planted within 30 days of ME01754. As presented in Table 22, the oil content was increased to 124% and 131% in seed from events-02 and -04, respectively, compared to the population mean.

TABLE 22

Oil content (% control) in $T_2$ and $T_3$ seed from ME01754 events containing Ceres Clone 368

|  | Event-01 | Event-02 | Event-03 | Event-04 | Event-05 | Control |
|---|---|---|---|---|---|---|
| Oil content (% control) in $T_2$ seed | 100 | 124 | 113 | 131 | 89 | 100 ± 9* |
| p-value** | 0.18 | 0.01 | 0.08 | <0.01 | 0.10 | N/A |
| Oil content (% control) in $T_3$ seed | 97 ± 2 | 103 ± 2 | 109 ± 3 | 96 ± 1 | No data | 100 ± 4 |
| p-value*** | 0.11 | 0.02 | 0.10 | <0.01 | No data | N/A |

*Population mean of the oil content in seed from transgenic lines planted within 30 days of ME01754. Variation is presented as the standard error of the mean.
**The p-values for $T_2$ seed were calculated using z-scores.
***The p-values for $T_3$ seed were calculated using a Student's t-test.

The oil content in $T_3$ seed from one event of ME01754 was significantly increased compared to the oil content in corresponding control seed. As presented in Table 22, the oil content was increased to 103% in seed from event-02 compared to the oil content in control seed. The oil content in $T_3$ seed from one event of ME01754 was significantly decreased compared to the oil content in corresponding control seed. As presented in Table 22, the oil content was decreased to 96% in seed from event-04 compared to the oil content in control seed.

Example 21

Determination of Functional Homolog and/or Ortholog Sequences

A subject sequence was considered a functional homolog or ortholog of a query sequence if the subject and query sequences encoded proteins having a similar function and/or activity. A process known as Reciprocal BLAST (Rivera et al., *Proc. Natl. Acad. Sci. USA*, 95:6239-6244 (1998)) was used to identify potential functional homolog and/or ortholog sequences from databases consisting of all available public and proprietary peptide sequences, including NR from NCBI and peptide translations from Ceres clones.

Before starting a Reciprocal BLAST process, a specific query polypeptide was searched against all peptides from its source species using BLAST in order to identify polypeptides having BLAST sequence identity of 80% or greater to the query polypeptide and an alignment length of 85% or greater along the shorter sequence in the alignment. The query polypeptide and any of the aforementioned identified polypeptides were designated as a cluster.

The BLASTP version 2.0 program from Washington University at Saint Louis, Mo., USA was used to determine BLAST sequence identity and E-value. The BLASTP version 2.0 program includes the following parameters: 1) an E-value cutoff of 1.0e-5; 2) a word size of 5; and 3) the -postsw option. The BLAST sequence identity was calculated based on the alignment of the first BLAST HSP (High-scoring Segment Pairs) of the identified potential functional homolog and/or ortholog sequence with a specific query polypeptide. The number of identically matched residues in the BLAST HSP alignment was divided by the HSP length, and then multiplied by 100 to get the BLAST sequence identity. The HSP length typically included gaps in the alignment, but in some cases gaps were excluded.

The main Reciprocal BLAST process consists of two rounds of BLAST searches; forward search and reverse search. In the forward search step, a query polypeptide sequence, "polypeptide A," from source species SA was BLASTed against all protein sequences from a species of interest. Top hits were determined using an E-value cutoff of $10^{-5}$ and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original query polypeptide was considered a potential functional homolog or ortholog as well. This process was repeated for all species of interest.

In the reverse search round, the top hits identified in the forward search from all species were BLASTed against all protein sequences from the source species SA. A top hit from the forward search that returned a polypeptide from the aforementioned cluster as its best hit was also considered as a potential functional homolog or ortholog.

Functional homologs and/or orthologs were identified by manual inspection of potential functional homolog and/or ortholog sequences. Representative functional homologs and/or orthologs for SEQ ID NO:81, SEQ ID NO:94, SEQ ID NO:111, SEQ ID NO:136, SEQ ID NO:152, SEQ ID NO:159, SEQ ID NO:171, SEQ ID NO:176, SEQ ID NO:178, SEQ ID NO:193, SEQ ID NO:332, SEQ ID NO:342, SEQ ID NO:344, SEQ ID NO:346, SEQ ID NO:359, SEQ ID NO:374, and SEQ ID NO:398 are shown in FIGS. 1-13, respectively. The percent identities of functional homologs and/or orthologs to SEQ ID NO:81, SEQ ID NO:94, SEQ ID NO:111, SEQ ID NO:136, SEQ ID NO:152, SEQ ID NO:159, SEQ ID NO:171, SEQ ID NO:176, SEQ ID NO:178, SEQ ID NO:193, SEQ ID NO:332, SEQ ID NO:342, SEQ ID NO:344, SEQ ID NO:346, SEQ ID NO:359, SEQ ID NO:374, and SEQ ID NO:398 are shown below in Tables 23-34, respectively. The BLAST sequence identities and E-values given in Tables 23-34 were taken from the forward search round of the Reciprocal BLAST process.

TABLE 23

Percent identity to Ceres Clone 41573 (SEQ ID NO: 81)

| Designation | Species | SEQ ID NO: | % Identity | e-value |
|---|---|---|---|---|
| Ceres CLONE ID no. 1560908 | *Zea mays* | 82 | 54.9 | 2.49E-82 |
| Public GI no. 2739168 | *Nicotiana tabacum* | 83 | 54.6 | 8.99E-85 |
| Ceres CLONE ID no. 399052 | *Zea mays* | 84 | 54.5 | 1.19E-82 |

TABLE 23-continued

Percent identity to Ceres Clone 41573 (SEQ ID NO: 81)

| Designation | Species | SEQ ID NO: | % Identity | e-value |
|---|---|---|---|---|
| Ceres CLONE ID no. 1314177 | Triticum aestivum | 85 | 54.2 | 1.49E−82 |
| Public GI no. 15824567 | Nicotiana tabacum | 86 | 53.9 | 2.09E−85 |
| Ceres CLONE ID no. 1371577 | Glycine max | 87 | 53.2 | 2.90E−79 |
| Public GI no. 15824565 | Nicotiana tabacum | 88 | 53.2 | 1.90E−84 |
| Public GI no. 50920801 | Oryza sativa subsp. japonica | 89 | 53.2 | 1.80E−77 |
| Public GI no. 50909807 | Oryza sativa subsp. japonica | 90 | 51.8 | 7.20E−76 |
| Ceres CLONE ID no. 639223 | Triticum aestivum | 91 | 51.2 | 1.20E−75 |
| Public GI no. 37531218 | Oryza sativa | 92 | 51.2 | 1.80E−72 |
| Ceres CLONE ID no. 1476735 | Populus balsamifera subsp. trichocarpa | 502 | 63.8 | 2.00E−96 |

TABLE 24

Percent identity to Ceres Clone 25429 (SEQ ID NO: 94)

| Designation | Species | SEQ ID NO: | % Identity | e-value |
|---|---|---|---|---|
| Ceres Annot: 1488311_PRT | Populus balsamifera subsp. trichocarpa | 96 | 75 | 1.70E−35 |
| Ceres CLONE ID no. 953928 | Brassica napus | 97 | 74.7 | 1.49E−34 |
| Ceres CLONE ID no. 524682 | Glycine max | 98 | 74.5 | 3.60E−33 |
| Ceres CLONE ID no. 1609735 | Parthenium argentatum | 99 | 73.4 | 1.29E−28 |
| Ceres CLONE ID no. 949174 | Brassica napus | 100 | 73.4 | 2.40E−36 |
| Ceres CLONE ID no. 1299820 | Brassica napus | 101 | 72.5 | 3.90E−36 |
| Public GI no. 42565379 | Hyacinthus orientalis | 102 | 72.5 | 1.30E−35 |
| Ceres CLONE ID no. 426736 | Zea mays | 103 | 71.6 | 2.80E−35 |
| Ceres CLONE ID no. 1094375 | Brassica napus | 104 | 71.4 | 1.39E−33 |
| Ceres CLONE ID no. 691062 | Glycine max | 105 | 71.1 | 2.89E−33 |
| Public GI no. 47026878 | Hyacinthus orientalis | 106 | 70.7 | 2.49E−34 |
| Public GI no. 24473796 | Prunus dulcis | 107 | 69.9 | 8.20E−36 |
| Ceres Annot: 1465437_PRT | Populus balsamifera subsp. trichocarpa | 109 | 67.2 | 3.39E−30 |
| Ceres CLONE ID no. 1798334 | Gossypium hirsutum | 503 | 76.7 | 7.99E−38 |
| Ceres CLONE ID no. 1886478 | Gossypium hirsutum | 504 | 76.3 | 9.50E−35 |
| Ceres CLONE ID no. 1727128 | Musa acuminate | 505 | 72.9 | 6.89E−32 |
| Public GI no. 730583 | Parthenium argentatum | 506 | 66 | 3.30E−32 |

TABLE 25

Percent identity to Ceres Clone 5750 (SEQ ID NO: 111)

| Designation | Species | SEQ ID NO: | % Identity | e-value |
|---|---|---|---|---|
| Public GI no. 42362268 | Glycine max | 112 | 96.5 | 1.20E−41 |
| Ceres CLONE ID no. 709027 | Glycine max | 113 | 96.5 | 1.20E−41 |
| Ceres CLONE ID no. 853298 | Glycine max | 114 | 96.5 | 1.20E−41 |
| Ceres CLONE ID no. 1417425 | Glycine max | 115 | 96.5 | 1.20E−41 |
| Public GI no. 27435806 | Populus tremula x Populus tremuloides | 116 | 94.8 | 9.09E−37 |
| Ceres Annot: 1481954_PRT | Populus balsamifera subsp. trichocarpa | 118 | 94.8 | 9.09E−37 |
| Public GI no. 45935118 | Ipomoea trifida | 119 | 94.2 | 5.19E−41 |
| Ceres CLONE ID no. 1017141 | Triticum aestivum | 120 | 93.8 | 3.79E−38 |
| Ceres CLONE ID no. 1448636 | Zea mays | 121 | 93.8 | 3.79E−38 |
| Public GI no. 50919707 | Oryza sativa subsp. japonica | 122 | 93.8 | 3.79E−38 |
| Public GI no. 40641585 | Triticum aestivum | 123 | 93.8 | 3.79E−38 |
| Public GI no. 38566522 | Arabidopsis thaliana | 124 | 93.75 | 4.39E−37 |
| Ceres CLONE ID no. 1338131 | Arabidopsis thaliana | 125 | 93.75 | 4.39E−37 |
| Ceres CLONE ID no. 300692 | Zea mays | 126 | 90.8 | 9.79E−40 |
| Ceres CLONE ID no. 947192 | Brassica napus | 127 | 90.8 | 3.30E−39 |
| Ceres CLONE ID no. 1465004 | Zea mays | 128 | 90.8 | 8.80E−39 |
| Ceres CLONE ID no. 1122958 | Brassica napus | 129 | 89.6 | 6.19E−38 |
| Ceres CLONE ID no. 944737 | Brassica napus | 130 | 86.4 | 9.69E−33 |
| Ceres CLONE ID no. 217797 | Zea mays | 131 | 85.1 | 5.80E−35 |
| Ceres CLONE ID no. 520185 | Glycine max | 132 | 85.1 | 5.80E−35 |
| Public GI no. 55978016 | Ostreococcus tauri | 133 | 83 | 2.09E−30 |
| Ceres CLONE ID no. 1436585 | Zea mays | 134 | 82.7 | 2.49E−34 |
| Ceres CLONE ID no. 1777369 | Panicum virgatum | 507 | 96.1 | 1.70E−37 |
| Ceres CLONE ID no. 1744578 | Musa acuminata | 508 | 95 | 5.49E−39 |
| Ceres CLONE ID no. 100008703 | Gossypium hirsutum | 509 | 94.2 | 1.80E−40 |
| Ceres CLONE ID no. 1723582 | Musa acuminata | 510 | 93.8 | 1.10E−38 |

TABLE 26

Percent identity to Ceres Clone 218626 (SEQ ID NO: 136)

| Designation | Species | SEQ ID NO: | % Identity | e-value |
|---|---|---|---|---|
| Public GI no. 30409136 | *Oryza sativa* subsp. *indica* | 137 | 91.9 | 3.90E−219 |
| Public GI no. 50940751 | *Oryza sativa* subsp. *japonica* | 138 | 91 | 3.29E−222 |
| Ceres CLONE ID no. 1571117 | *Zea mays* | 139 | 84.9 | 3.70E−207 |
| Ceres CLONE ID no. 424395 | *Zea mays* | 140 | 83.9 | 2.50E−201 |
| Ceres Annot: 1440705_PRT | *Populus balsamifera* subsp. *trichocarpa* | 142 | 81.8 | 1.70E−161 |
| Ceres Annot: 1493584_PRT | *Populus balsamifera* subsp. *trichocarpa* | 144 | 81.6 | 4.19E−174 |
| Ceres Annot: 1463076_PRT | *Populus balsamifera* subsp. *trichocarpa* | 146 | 79.2 | 1.80E−159 |
| Ceres CLONE ID no. 1002421 | *Arabidopsis thaliana* | 147 | 79.1 | 9.99E−171 |
| Ceres Annot: 1516369_PRT | *Populus balsamifera* subsp. *trichocarpa* | 149 | 78.6 | 1.20E−153 |
| Public GI no. 30693666 | *Arabidopsis thaliana* | 150 | 78.3 | 3.40E−188 |
| Ceres CLONE ID no. 1796001 | *Panicum virgatum* | 511 | 85.8 | 1.19E−208 |

TABLE 27

Percent identity to Ceres Clone 121021 (SEQ ID NO: 152)

| Designation | Species | SEQ ID NO: | % Identity | e-value |
|---|---|---|---|---|
| Ceres Annot: 1501628_PRT | *Populus balsamifera* subsp. *trichocarpa* | 154 | 57.6 | 1.79E−17 |
| Ceres Annot: 1519046_PRT | *Populus balsamifera* subsp. *trichocarpa* | 156 | 52.8 | 7.69E−24 |
| Ceres CLONE ID no. 1121512 | *Glycine max* | 157 | 51.7 | 9.09E−21 |

TABLE 28

Percent identity to Ceres Clone 158765 (SEQ ID NO: 159)

| Designation | Species | SEQ ID NO: | % Identity | e-value |
|---|---|---|---|---|
| Public GI no. 32562996 | *Arabidopsis thaliana* | 160 | 97.9 | 5.19E−73 |
| Public GI no. 5669656 | *Lycopersicon esculentum* | 161 | 66.1 | 5.00E−36 |
| Ceres CLONE ID no. 754061 | *Triticum aestivum* | 162 | 65.3 | 6.99E−30 |
| Ceres CLONE ID no. 1329861 | *Triticum aestivum* | 163 | 65.3 | 6.99E−30 |
| Ceres CLONE ID no. 537752 | *Glycine max* | 164 | 65.1 | 1.10E−40 |
| Ceres CLONE ID no. 1322549 | *Triticum aestivum* | 165 | 64.2 | 1.90E−29 |
| Ceres CLONE ID no. 282892 | *Zea mays* | 166 | 62.2 | 4.90E−29 |

TABLE 28-continued

Percent identity to Ceres Clone 158765 (SEQ ID NO: 159)

| Designation | Species | SEQ ID NO: | % Identity | e-value |
|---|---|---|---|---|
| Ceres CLONE ID no. 284046 | *Zea mays* | 167 | 62.2 | 1.29E−28 |
| Ceres CLONE ID no. 1388825 | *Zea mays* | 168 | 61.6 | 4.90E−29 |
| Public GI no. 50925813 | *Oryza sativa* subsp. *japonica* | 169 | 50 | 1.60E−30 |
| Ceres CLONE ID no. 1839717 | *Gossypium hirsutum* | 545 | 72.8 | 5.09E−36 |

TABLE 29

Percent identity to Ceres Clone 16403 (SEQ ID NO: 171)

| Designation | Species | SEQ ID NO: | % Identity | e-value |
|---|---|---|---|---|
| Ceres CLONE ID no. 611156 | *Glycine max* | 172 | 58.9 | 7.29E−67 |
| Ceres Annot: 1464944_PRT | *Populus balsamifera* subsp. *trichocarpa* | 174 | 56.2 | 4.39E−60 |
| Ceres CLONE ID no. 1728680 | *Musa acuminata* | 530 | 60.2 | 1.70E−58 |
| Ceres CLONE ID no. 1807796 | *Gossypium hirsutum* | 531 | 59.1 | 8.00E−70 |
| Ceres CLONE ID no. 1771837 | *Panicum virgatum* | 532 | 52.3 | 4.69E−56 |
| Ceres CLONE ID no. 1773482 | *Panicum virgatum* | 533 | 51.4 | 4.69E−56 |

TABLE 30

Percent identity to Ceres Clone 28635 (SEQ ID NO: 178)

| Designation | Species | SEQ ID NO: | % Identity | e-value |
|---|---|---|---|---|
| Public GI no. 2463569 | *Glycine max* | 179 | 80.6 | 1.80E−180 |
| Ceres | *Populus balsamifera* | 181 | 79.9 | 6.20E−157 |

TABLE 30-continued

Percent identity to Ceres Clone 28635 (SEQ ID NO: 178)

| Designation | Species | SEQ ID NO: | % Identity | e-value |
|---|---|---|---|---|
| Annot: 1514021_PRT | subsp. *trichocarpa* | | | |
| Public GI no. 55710094 | *Centella asiatica* | 182 | 79.8 | 2.49E−176 |
| Ceres Annot: 1503464_PRT | *Populus balsamifera* subsp. *trichocarpa* | 184 | 79.7 | 2.90E−166 |
| Public GI no. 75859951 | *Panax notoginseng* | 185 | 78.8 | 2.19E−177 |
| Public GI no. 1449163 | *Glycyrrhiza glabra* | 186 | 78.8 | 5.19E−176 |
| Public GI no. 1449165 | *Glycyrrhiza glabra* | 187 | 78.1 | 3.69E−175 |
| Public GI no. 28208268 | *Lotus japonicus* | 188 | 78.1 | 1.60E−172 |
| Public GI no. 41224629 | *Panax ginseng* | 189 | 77.8 | 3.69E−175 |
| Public GI no. 27475614 | *Medicago truncatula* | 190 | 77.8 | 2.10E−172 |
| Public GI no. 38426486 | *Artemisia annua* | 191 | 77 | 8.10E−171 |
| Ceres CLONE ID no. 1920025 | *Gossypium hirsutum* | 534 | 79.2 | 9.80E−175 |
| Public GI no. 110293133 | *Polygala tenuifolia* | 535 | 78.6 | 2.29E−175 |
| Public GI no. 5360655 | *Solanum tuberosum* | 536 | 76.0 | 1.5E−171 |
| Public GI no. 4426953 | *Capsicum annuum* | 537 | 75.7 | 2.2E−170 |
| Public GI no. 1552717 | *Nicotiana tabacum* | 538 | 75.5 | 1.9E−171 |
| Public GI no. 66393825 | *Bupleurum falcatum* | 539 | 75.9 | 1.69E−170 |
| Public GI no. 1706774 | *Nicotiana benthamiana* | 540 | 74.8 | 2.5E−169 |
| Ceres CLONE ID no. 1749989 | *Panicum virgatum* | 541 | 69.8 | 3.20E−153 |
| Public GI no. 115456049 | *Oryza sativa* subsp. *japonica* | 542 | 68.6 | 1.60E−149 |
| Public GI no. 2463567 | *Zea mays* | 543 | 68.3 | 3.79E−150 |
| Ceres CLONE ID no. 706088 | *Triticum aestivum* | 544 | 65.1 | 5.9E−145 |

TABLE 31

Percent identity to Ceres Clone 35698 (SEQ ID NO: 193)

| Designation | Species | SEQ ID NO: | % Identity | e-value |
|---|---|---|---|---|
| Ceres CLONE ID no. 1346445 | *Arabidopsis thaliana* | 194 | 98.6 | 1.90E−36 |
| Public GI no. 441457 | *Lycopersicon esculentum* | 195 | 98 | 8.20E−52 |
| Public GI no. 19347859 | *Arabidopsis thaliana* | 196 | 98 | 3.49E−51 |
| Ceres Annot: 1483290_PRT | *Populus balsamifera* subsp. *trichocarpa* | 198 | 97 | 2.80E−51 |
| Public GI no. 40287554 | *Capsicum annuum* | 199 | 97 | 1.29E−51 |
| Public GI no. 21553796 | *Arabidopsis thaliana* | 200 | 97 | 2.20E−51 |
| Public GI no. 28569271 | *Gossypium thurberi* | 201 | 97 | 2.20E−51 |
| Public GI no. 28569265 | *Gossypium hirsutum* | 202 | 97 | 2.20E−51 |
| Public GI no. 66354420 | *Arabidopsis thaliana* | 203 | 97 | 2.20E−51 |
| Public GI no. 21280893 | *Arabidopsis thaliana* | 204 | 97 | 2.20E−51 |
| Public GI no. 21554343 | *Arabidopsis thaliana* | 205 | 97 | 2.20E−51 |
| Public GI no. 22597164 | *Glycine max* | 206 | 97 | 4.50E−51 |
| Ceres CLONE ID no. 617835 | *Triticum aestivum* | 207 | 96 | 9.40E−51 |
| Public GI no. 30693871 | *Arabidopsis thaliana* | 208 | 96 | 8.40E−50 |
| Public GI no. 5762457 | *Mesembryanthemum crystallinum* | 209 | 96 | 4.50E−51 |
| Public GI no. 464981 | *Lycopersicon esculentum* | 210 | 96 | 4.50E−51 |
| Public GI no. 456568 | *Pisum sativum* | 211 | 96 | 4.50E−51 |
| Public GI no. 77416935 | *Solanum tuberosum* | 212 | 96 | 3.49E−51 |
| Public GI no. 28569267 | *Gossypium arboreum* | 213 | 96 | 3.49E−51 |
| Public GI no. 28569261 | *Gossypium hirsutum* | 214 | 96 | 3.49E−51 |
| Ceres CLONE ID no. 39130 | *Arabidopsis thaliana* | 215 | 95.8 | 9.99E−36 |
| Ceres CLONE ID no. 16865 | *Arabidopsis thaliana* | 216 | 95.8 | 9.99E−36 |
| Ceres CLONE ID no. 575067 | *Glycine max* | 217 | 95.8 | 1.30E−35 |
| Ceres Annot: 1467392_PRT | *Populus balsamifera* subsp. *trichocarpa* | 219 | 95.8 | 1.30E−35 |
| Ceres CLONE ID no. 25162 | *Arabidopsis thaliana* | 220 | 95.8 | 9.99E−36 |
| Ceres Annot: 1529647_PRT | *Populus balsamifera* subsp. *trichocarpa* | 222 | 95.8 | 8.20E−36 |
| Ceres CLONE ID no. 1405728 | *Zea mays* | 223 | 95.8 | 8.20E−36 |

TABLE 31-continued

Percent identity to Ceres Clone 35698 (SEQ ID NO: 193)

| Designation | Species | SEQ ID NO: | % Identity | e-value |
|---|---|---|---|---|
| Public GI no. 54288726 | Picea abies | 224 | 95.3 | 9.99E−31 |
| Public GI no. 50906823 | Oryza sativa subsp. japonica | 225 | 95 | 1.20E−50 |
| Public GI no. 83306206 | Oryza sativa subsp. indica | 226 | 95 | 3.19E−50 |
| Public GI no. 20152203 | Oryza sativa subsp. japonica | 227 | 95 | 1.89E−50 |
| Public GI no. 40287568 | Capsicum annuum | 228 | 94.5 | 2.20E−35 |
| Public GI no. 50929483 | Oryza sativa subsp. japonica | 229 | 94.1 | 4.00E−50 |
| Ceres Annot: 1450556_PRT | Populus balsamifera subsp. trichocarpa | 231 | 93.1 | 4.50E−35 |
| Ceres CLONE ID no. 1031152 | Triticum aestivum | 232 | 93.1 | 8.40E−50 |
| Public GI no. 52548244 | Triticum aestivum | 233 | 93.1 | 8.40E−50 |
| Public GI no. 82621144 | Solanum tuberosum | 234 | 92.8 | 7.60E−33 |
| Ceres CLONE ID no. 878043 | Triticum aestivum | 235 | 92.1 | 2.80E−49 |
| Public GI no. 34909292 | Oryza sativa subsp. japonica | 236 | 92.1 | 2.80E−49 |
| Public GI no. 2668744 | Zea mays | 237 | 92.1 | 2.80E−49 |
| Ceres CLONE ID no. 511132 | Glycine max | 238 | 91.7 | 9.40E−35 |
| Ceres Annot: 1533930_PRT | Populus balsamifera subsp. trichocarpa | 240 | 91.7 | 1.19E−34 |
| Ceres Annot: 1495171_PRT | Populus balsamifera subsp. trichocarpa | 242 | 91.1 | 9.99E−38 |
| Public GI no. 20086317 | Oryza sativa | 243 | 90.5 | 3.19E−50 |
| Ceres CLONE ID no. 10022 | Arabidopsis thaliana | 244 | 90.4 | 4.09E−34 |
| Ceres CLONE ID no. 12547 | Arabidopsis thaliana | 245 | 90.4 | 4.09E−34 |
| Ceres CLONE ID no. 27679 | Arabidopsis thaliana | 246 | 90.4 | 4.09E−34 |
| Public GI no. 20259611 | Arabidopsis thaliana | 247 | 90.1 | 9.60E−49 |
| Public GI no. 30025160 | Hordeum vulgare | 248 | 90.1 | 5.30E−48 |
| Public GI no. 50904839 | Oryza sativa subsp. japonica | 249 | 89.2 | 9.60E−49 |
| Ceres CLONE ID no. 1063753 | Zea mays | 250 | 89.2 | 8.69E−48 |
| Ceres Annot: 1533218_PRT | Populus balsamifera subsp. trichocarpa | 252 | 89 | 1.09E−33 |
| Public GI no. 297880 | Arabidopsis thaliana | 253 | 88.8 | 2.89E−33 |
| Ceres CLONE ID no. 1357060 | Zea mays | 254 | 88.2 | 1.09E−47 |
| Public GI no. 54402104 | Arachis hypogaea | 255 | 87.2 | 2.89E−47 |
| Public GI no. 50725323 | Oryza sativa subsp. japonica | 256 | 87.2 | 1.29E−46 |
| Ceres CLONE ID no. 376667 | Zea mays | 257 | 87.2 | 9.89E−47 |
| Ceres CLONE ID no. 256705 | Zea mays | 258 | 86.8 | 1.50E−41 |
| Public GI no. 20259629 | Arabidopsis thaliana | 259 | 86.2 | 4.80E−47 |
| Public GI no. 52851174 | Plantago major | 260 | 86.2 | 6.09E−47 |
| Ceres CLONE ID no. 1061097 | Zea mays | 261 | 86.2 | 1.60E−46 |
| Public GI no. 1373001 | Oryza sativa | 262 | 86.2 | 4.39E−44 |
| Public GI no. 66354468 | Arabidopsis thaliana | 263 | 86.2 | 9.89E−47 |
| Public GI no. 4100646 | Pinus resinosa | 264 | 82.3 | 2.40E−45 |
| Ceres CLONE ID no. 1380019 | Zea mays | 265 | 98 | 2.80E−51 |
| Ceres CLONE ID no. 1380019_T | Artificial Sequence | 266 | 98.04 | 4.80E−56 |
| Ceres CLONE ID no. 1346445_T | Artificial Sequence | 267 | 98.63 | 3.30E−41 |
| Public GI no. 441457_T | Artificial Sequence | 268 | 98.04 | 1.40E−56 |
| Public GI no. 19347859_T | Artificial Sequence | 269 | 98.04 | 6.10E−56 |
| Ceres Annot: 1483290_T | Populus balsamifera subsp. trichocarpa | 270 | 97.06 | 4.80E−56 |
| Public GI no. 40287554_T | Artificial Sequence | 271 | 97.06 | 2.30E−56 |
| Public GI no. 21553796_T | Artificial Sequence | 272 | 97.06 | 3.70E−56 |
| Public GI no. 28569271_T | Artificial Sequence | 273 | 97.06 | 3.70E−56 |

TABLE 31-continued

Percent identity to Ceres Clone 35698 (SEQ ID NO: 193)

| Designation | Species | SEQ ID NO: | % Identity | e-value |
|---|---|---|---|---|
| Public GI no. 28569265_T | Artificial Sequence | 274 | 97.06 | 3.70E−56 |
| Public GI no. 66354420_T | Artificial Sequence | 275 | 97.06 | 3.70E−56 |
| Public GI no. 21280893_T | Artificial Sequence | 276 | 97.06 | 3.70E−56 |
| Public GI no. 21554343_T | Artificial Sequence | 277 | 97.06 | 3.70E−56 |
| Public GI no. 22597164_T | Artificial Sequence | 278 | 97.03 | 7.80E−56 |
| Ceres CLONE ID no. 617835_T | Artificial Sequence | 279 | 96.08 | 1.60E−55 |
| Public GI no. 30693871_T | Artificial Sequence | 280 | 96.08 | 1.50E−54 |
| Public GI no. 5762457_T | Artificial Sequence | 281 | 96.08 | 7.80E−56 |
| Public GI no. 464981_T | Artificial Sequence | 282 | 96.08 | 7.80E−56 |
| Public GI no. 456568_T | Artificial Sequence | 283 | 96.08 | 7.80E−56 |
| Public GI no. 77416935_T | Artificial Sequence | 284 | 96.08 | 6.10E−56 |
| Public GI no. 28569267_T | Artificial Sequence | 285 | 96.08 | 6.10E−56 |
| Public GI no. 28569261_T | Artificial Sequence | 286 | 96.08 | 6.10E−56 |
| Ceres CLONE ID no. 39130_T | Artificial Sequence | 287 | 95.89 | 1.80E−40 |
| Ceres CLONE ID no. 16865_T | Artificial Sequence | 288 | 95.89 | 1.80E−40 |
| Ceres CLONE ID no. 575067_T | Artificial Sequence | 289 | 95.89 | 2.30E−40 |
| Ceres Annot: 1467392_T | Populus balsamifera subsp. trichocarpa | 290 | 95.89 | 2.30E−40 |
| Ceres CLONE ID no. 25162_T | Artificial Sequence | 291 | 95.89 | 1.80E−40 |
| Ceres Annot: 1529647_T | Populus balsamifera subsp. trichocarpa | 292 | 95.89 | 1.40E−40 |
| Ceres CLONE ID no. 1405728_T | Artificial Sequence | 293 | 95.89 | 1.40E−40 |
| Public GI no. 54288726_T | Artificial Sequence | 294 | 95.38 | 1.70E−35 |
| Public GI no. 50906823_T | Artificial Sequence | 295 | 95.1 | 2.10E−55 |
| Public GI no. 83306206_T | Artificial Sequence | 296 | 95.1 | 5.50E−55 |
| Public GI no. 20152203_T | Artificial Sequence | 297 | 95.1 | 3.40E−55 |
| Public GI no. 40287568_T | Artificial Sequence | 298 | 94.52 | 3.80E−40 |
| Public GI no. 50929483_T | Artificial Sequence | 299 | 94.12 | 7.00E−55 |
| Ceres Annot: 1450556_T | Populus balsamifera subsp. trichocarpa | 300 | 93.15 | 7.80E−40 |
| Ceres CLONE ID no. 1031152_T | Artificial Sequence | 301 | 93.14 | 1.50E−54 |
| Public GI no. 52548244_T | Artificial Sequence | 302 | 93.14 | 1.50E−54 |
| Public GI no. 82621144_T | Artificial Sequence | 303 | 92.86 | 1.30E−37 |
| Ceres CLONE ID no. 878043_T | Artificial Sequence | 304 | 92.16 | 4.90E−54 |
| Public GI no. 34909292_T | Artificial Sequence | 305 | 92.16 | 4.90E−54 |
| Public GI no. 2668744_T | Artificial Sequence | 306 | 92.16 | 4.90E−54 |
| Ceres CLONE ID no. 511132_T | Artificial Sequence | 307 | 91.78 | 1.60E−39 |
| Ceres Annot: 1533930_T | Populus balsamifera subsp. trichocarpa | 308 | 91.78 | 2.10E−39 |
| Ceres Annot: 1495171_T | Populus balsamifera subsp. trichocarpa | 309 | 91.14 | 1.80E−42 |
| Public GI no. 20086317_T | Artificial Sequence | 310 | 94.12 | 7.00E−55 |
| Ceres CLONE ID no. 10022_T | Artificial Sequence | 311 | 90.41 | 7.00E−39 |
| Ceres CLONE ID no. 12547_T | Artificial Sequence | 312 | 90.41 | 7.00E−39 |

TABLE 31-continued

Percent identity to Ceres Clone 35698 (SEQ ID NO: 193)

| Designation | Species | SEQ ID NO: | % Identity | e-value |
|---|---|---|---|---|
| Ceres CLONE ID no. 27679_T | Artificial Sequence | 313 | 90.41 | 7.00E−39 |
| Public GI no. 20259611_T | Artificial Sequence | 314 | 90.2 | 1.70E−53 |
| Public GI no. 30025160_T | Artificial Sequence | 315 | 90.2 | 9.20E−53 |
| Public GI no. 50904839_T | Artificial Sequence | 316 | 89.22 | 1.70E−53 |
| Ceres CLONE ID no. 1063753_T | Artificial Sequence | 317 | 89.22 | 1.50E−52 |
| Ceres Annot: 1533218_T | Populus balsamifera subsp. trichocarpa | 318 | 89.04 | 1.90E−38 |
| Public GI no. 297880_T | Artificial Sequence | 319 | 88.89 | 4.90E−38 |
| Ceres CLONE ID no. 1357060_T | Artificial Sequence | 320 | 88.24 | 1.90E−52 |
| Public GI no. 54402104_T | Artificial Sequence | 321 | 87.25 | 5.10E−52 |
| Public GI no. 50725323_T | Artificial Sequence | 322 | 87.25 | 2.20E−51 |
| Ceres CLONE ID no. 376667_T | Artificial Sequence | 323 | 87.25 | 1.70E−51 |
| Ceres CLONE ID no. 256705_T | Artificial Sequence | 324 | 86.81 | 2.70E−46 |
| Public GI no. 20259629_T | Artificial Sequence | 325 | 86.27 | 8.30E−52 |
| Public GI no. 52851174_T | Artificial Sequence | 326 | 86.27 | 1.10E−51 |
| Ceres CLONE ID no. 1061097_T | Artificial Sequence | 327 | 86.27 | 2.80E−51 |
| Public GI no. 1373001_T | Artificial Sequence | 328 | 86.27 | 7.70E−49 |
| Public GI no. 66354468_T | Artificial Sequence | 329 | 86.27 | 1.70E−51 |
| Public GI no. 4100646_T | Artificial Sequence | 330 | 82.35 | 4.10E−50 |

TABLE 32

Percent identity to Ceres Clone 36412 (SEQ ID NO: 332)

| Designation | Species | SEQ ID NO: | % Identity | e-value |
|---|---|---|---|---|
| Public GI no. 3152583 | Arabidopsis thaliana | 333 | 98.5 | 2.00E−176 |
| Ceres Annot: 1467033_PRT | Populus balsamifera subsp. trichocarpa | 335 | 60.2 | 1.20E−68 |
| Ceres Annot: 1536919_PRT | Populus balsamifera subsp. trichocarpa | 337 | 60.1 | 7.90E−70 |
| Ceres CLONE ID no. 1641329 | Glycine max | 338 | 52.7 | 1.90E−61 |
| Ceres CLONE ID no. 1650419 | Glycine max | 339 | 52 | 1.39E−65 |
| Ceres CLONE ID no. 597699 | Glycine max | 340 | 51 | 1.09E−63 |

TABLE 33

Percent identity to Ceres Clone 4829 (SEQ ID NO: 346)

| Designation | Species | SEQ ID NO: | % Identity | e-value |
|---|---|---|---|---|
| Ceres CLONE ID no. 24885 | Arabidopsis thaliana | 347 | 87.2 | 8.89E−62 |
| Ceres CLONE ID no. 27878 | Arabidopsis thaliana | 348 | 84.2 | 1.19E−57 |
| Ceres Annot: 1485102_PRT | Populus balsamifera subsp. trichocarpa | 350 | 81.2 | 1.50E−52 |
| Ceres CLONE ID no. 1646533 | Glycine max | 351 | 72.8 | 2.30E−54 |
| Public GI no. 29371519 | Oryza sativa subsp. japonica | 352 | 63.4 | 5.99E−40 |
| Public GI no. 38347602 | Oryza sativa subsp. japonica | 353 | 63.4 | 5.99E−40 |
| Public GI no. 45935148 | Ipomoea trifida | 354 | 60.8 | 1.29E−39 |
| Ceres CLONE ID no. 359934 | Zea mays | 355 | 60.4 | 3.79E−38 |
| Ceres CLONE ID no. 294598 | Zea mays | 356 | 58.8 | 5.99E−40 |
| Ceres CLONE ID no. 839270 | Triticum aestivum | 357 | 55.1 | 3.10E−36 |
| Ceres CLONE ID no. 1836904 | Gossypium hirsutum | 525 | 78.6 | 1.40E−54 |
| Ceres CLONE ID no. 1932013 | Gossypium hirsutum | 526 | 77.3 | 7.99E−54 |
| Ceres CLONE ID no. 1768109 | Panicum virgatum | 527 | 58.1 | 7.79E−40 |

TABLE 34

Percent identity to Ceres Clone 5426 (SEQ ID NO: 359)

| Designation | Species | SEQ ID NO: | % Identity | e-value |
|---|---|---|---|---|
| Ceres CLONE ID no. 1123542 | Brassica napus | 360 | 90.3 | 3.99E−59 |
| Ceres CLONE ID no. 9083 | Arabidopsis thaliana | 361 | 90.2 | 4.80E−63 |
| Public GI no. 79322493 | Arabidopsis thaliana | 362 | 90.2 | 4.80E−63 |
| Ceres CLONE ID no. 265408 | Arabidopsis thaliana | 363 | 90.2 | 4.80E−63 |
| Ceres CLONE ID no. 32164 | Arabidopsis thaliana | 364 | 90.2 | 4.80E−63 |
| Ceres CLONE ID no. 1068047 | Brassica napus | 365 | 88.1 | 2.39E−61 |
| Ceres CLONE ID no. 965035 | Brassica napus | 366 | 87.4 | 6.30E−61 |
| Ceres Annot: 1499194_PRT | Populus balsamifera subsp. trichocarpa | 368 | 76.7 | 1.00E−53 |
| Ceres Annot: 1439584_PRT | Populus balsamifera subsp. trichocarpa | 370 | 75.5 | 3.40E−53 |
| Ceres CLONE ID no. 557065 | Glycine max | 371 | 73.4 | 5.60E−53 |
| Ceres CLONE ID no. 465060 | Glycine max | 372 | 72.5 | 1.29E−51 |
| Ceres CLONE ID no. 1458107 | Zea mays | 512 | 87.4 | 2.99E−61 |
| Ceres CLONE ID no. 1932511 | Gossypium hirsutum | 513 | 76.2 | 1.10E−54 |
| Ceres CLONE ID no. 1850967 | Gossypium hirsutum | 514 | 75.5 | 7.99E−54 |
| Ceres CLONE ID no. 1835707 | Gossypium hirsutum | 515 | 75.5 | 1.00E−53 |
| Ceres CLONE ID no. 1727213 | Musa acuminata | 516 | 72.7 | 5.19E−50 |
| Ceres CLONE ID no. 1767577 | Panicum virgatum | 517 | 71.3 | 9.69E−49 |
| Ceres CLONE ID no. 1712104 | Musa acuminata | 518 | 71.3 | 8.50E−50 |
| Ceres CLONE ID no. 1778377 | Panicum virgatum | 519 | 71.1 | 1.20E−48 |
| Public GI no. 76573317 | Solanum tuberosum | 520 | 70.6 | 4.10E−50 |
| Ceres CLONE ID no. 1787980 | Panicum virgatum | 521 | 69.9 | 1.29E−46 |
| Public GI no. 115465181 | Oryza sativa subsp. japonica | 522 | 69.7 | 6.89E−48 |
| Public GI no. 48716267 | Oryza sativa subsp. japonica | 523 | 69.7 | 8.69E−48 |
| Ceres CLONE ID no. 575833 | Triticum aestivum | 524 | 66.1 | 3.39E−46 |

TABLE 35

Percent identity to Ceres Clone 7894 (SEQ ID NO: 374)

| Designation | Species | SEQ ID NO: | % Identity | e-value |
|---|---|---|---|---|
| Public GI no. 18091781 | Brassica oleracea | 375 | 94.6 | 6.89E−261 |
| Public GI no. 468562 | Ricinus communis | 376 | 75.3 | 2.39E−194 |
| Ceres Annot: 1479767_PRT | Populus balsamifera subsp. trichocarpa | 378 | 74.7 | 4.30E−188 |
| Public GI no. 7649151 | Euphorbia esula | 379 | 74.3 | 9.99E−194 |
| Ceres Annot: 1486712_PRT | Populus balsamifera subsp. trichocarpa | 381 | 72.5 | 3.70E−182 |
| Public GI no. 33620334 | Glycine max | 382 | 71.9 | 3.29E−181 |
| Public GI no. 439294 | Solanum tuberosum | 383 | 71.6 | 4.39E−179 |
| Public GI no. 77153413 | Populus tremula x Populus tremuloides | 384 | 71.6 | 8.90E−181 |
| Public GI no. 5230818 | Pisum sativum | 385 | 71.1 | 1.40E−180 |
| Public GI no. 17447420 | Alonsoa meridionalis | 386 | 70.9 | 1.29E−179 |
| Public GI no. 1935019 | Vicia faba | 387 | 70.8 | 4.39E−179 |
| Public GI no. 51863031 | Juglans regia | 388 | 69.6 | 8.79E−174 |
| Public GI no. 575351 | Nicotiana tabacum | 389 | 69.3 | 4.39E−179 |
| Public GI no. 68161544 | Vitis vinifera | 390 | 68.7 | 7.39E−177 |
| Public GI no. 6434833 | Vitis vinifera | 391 | 68.5 | 1.49E−176 |
| Public GI no. 21319 | Spinacia oleracea | 392 | 68.2 | 9.99E−173 |
| Public GI no. 5823000 | Beta vulgaris | 393 | 67.7 | 2.69E−170 |
| Public GI no. 633172 | Beta vulgaris subsp. vulgaris | 394 | 67.3 | 8.99E−172 |
| Public GI no. 6120115 | Asarina barclaiana | 395 | 67.2 | 5.50E−172 |
| Public GI no. 415988 | Plantago major | 396 | 66.2 | 7.39E−177 |
| Public GI no. 116008246 | Hevea brasiliensis | 528 | 73 | 9.09E−188 |
| Ceres CLONE ID no. 1925996 | Gossypium hirsutum | 529 | 66.8 | 4.09E−176 |

Example 21

Transgenic Plants Containing Homologs and/or Orthologs

Cloned sequences of some of the functional homologs and/or orthologs of protein-modulating polypeptides that were identified as outlined in Example 20 were used to make transgenic plants.

Ceres Clone 39130 (SEQ ID NO:440) is a cDNA clone isolated from *Arabidopsis* that encodes a functional homologue of SEQ ID NO:193, and is predicted to encode a 119 amino acid transcription ubiquitin-conjugating enzyme polypeptide. Ceres Clone 424395 (SEQ ID NO:427) is a cDNA clone isolated from *Zea mays* that encodes a functional homologue of SEQ ID NO:136, and is predicted to encode a 446 amino acid tryptophan/tyrosine permease family polypeptide. Ceres Clone 24885 (SEQ ID NO:460) is a cDNA clone isolated from *Arabidopsis* that encodes a functional homologue of SEQ ID NO:346, and is predicted to encode a 156 amino acid polypeptide having a DUF662 domain. Ceres Clone 300692 (SEQ ID NO:418) is a cDNA clone isolated from *Zea mays* that encodes a functional homologue of SEQ ID NO:111, and is predicted to encode an 87 amino acid cyclin-dependent kinase regulatory subunit polypeptide. Ceres Clone 944737 (SEQ ID NO:422) is a cDNA clone isolated from *Brassica napus* that encodes a functional homologue of SEQ ID NO:111, and is predicted to encode an 81 amino acid cyclin-dependent kinase regulatory subunit polypeptide.

A construct was made with the CRS 311 vector that contained Ceres Clone 39130 operably linked to the 32449 promoter. Constructs were made with the CRS 338 vector that contained Ceres Clone 424395, Ceres Clone 24885, Ceres Clone 300692, or Ceres Clone 944737, each operably linked to a CaMV 35S promoter. Wild-type *Arabidopsis thaliana* ecotype Wassilewskija (Ws) plants were transformed separately with each construct as described in Example 1.

Transgenic *Arabidopsis* lines containing Ceres Clone 39130, Ceres Clone 424395, Ceres Clone 24885, Ceres Clone 300692, or Ceres Clone 944737 were designated ME00177, ME06339, ME07409, ME08044, or ME08488, respectively. The presence of each vector containing a Ceres clone described above in the respective transgenic *Arabidopsis* line transformed with the vector was confirmed by Finale™ resistance, polymerase chain reaction (PCR) amplification from green leaf tissue extract, and/or sequencing of PCR products. As controls, wild-type *Arabidopsis* ecotype Ws plants were transformed with the empty vector CRS 338 or the empty vector CRS 311.

Example 22

Results for Transgenic Plants Containing Homologs and/or Orthologs $T_2$ seed from three events of ME00177 containing Ceres Clone 39130 was analyzed for total oil content using FT-NIR spectroscopy as described in Example 2.

The oil content in $T_2$ seed from three events of ME00177 was increased compared to the mean oil content in seed from transgenic *Arabidopsis* lines planted within 30 days of ME00177. As presented in Table 36, the oil content was increased to 115%, 109%, and 122% in seed from events-01, -02, and -03, respectively, compared to the population mean.

TABLE 36

Oil content (% control) in $T_2$ seed from ME00177 events containing Ceres Clone 39130

|  | Event -01 | Event -02 | Event -03 | Control |
| --- | --- | --- | --- | --- |
| Protein content (% control) in $T_2$ seed | 115 | 109 | 122 | 100 ± 7* |
| p-value** | 0.04 | 0.15 | <0.01 | N/A |

*Population mean of the protein content in seed from transgenic lines planted within 30 days of ME00177. Variation is presented as standard error of the mean.
**The p-values for $T_2$ seed were calculated using z-scores.

$T_2$ seed from three events of ME06339 containing Ceres Clone 424395 was analyzed for total oil content using FT-NIR spectroscopy as described in Example 2.

The oil content in $T_2$ seed from three events of ME06339 was increased compared to the mean oil content in seed from transgenic *Arabidopsis* lines planted within 30 days of ME06339. As presented in Table 37, the protein content was increased to 110%, 103%, and 110% in seed from events-02, -03, and -04, respectively, compared to the population mean.

TABLE 37

Oil content (% control) in $T_2$ seed from ME06339 events containing Ceres Clone 424395

|  | Event -02 | Event -03 | Event -04 | Control |
| --- | --- | --- | --- | --- |
| Protein content (% control) in $T_2$ seed | 110 | 103 | 110 | 100 ± 12* |
| p-value | 0.06 | 0.401 | 0.068 | N/A |

*Population mean of the protein content in seed from transgenic lines planted within 30 days of ME06339. Variation is presented as standard error of the mean.

$T_2$ seed from four events of ME07409 containing Ceres Clone 24885 was analyzed for total oil content using FT-NIR spectroscopy as described in Example 2.

The oil content in $T_2$ seed from four events of ME07409 was modulated compared to the mean oil content in seed from transgenic *Arabidopsis* lines planted within 30 days of ME07409. As presented in Table 38, the oil content was increased to 107%, 103%, and 108% in seed from events-02, -03, and -04, respectively, compared to the population mean, while the oil content was decreased to 98% of the population mean in event-06.

TABLE 38

Oil content (% control) in $T_2$ seed from ME07409 events containing Ceres Clone 24885

|  | Event -02 | Event -03 | Event -04 | Event -06 | Control |
| --- | --- | --- | --- | --- | --- |
| Protein content (% control) in $T_2$ seed | 107 | 103 | 108 | 108 | 100 ± 13* |
| p-value** | 0.06 | 0.224 | 0.04 | 0.551 | N/A |

*Population mean of the protein content in seed from transgenic lines planted within 30 days of ME07409. Variation is presented as standard error of the mean.
**The p-values for $T_2$ seed were calculated using z-scores.

$T_2$ seed from four events of ME08044 containing Ceres Clone 300692 was analyzed for total oil content using FT-NIR spectroscopy as described in Example 2.

The oil content in $T_2$ seed from four events of ME08044 was modulated compared to the mean oil content in seed from transgenic *Arabidopsis* lines planted within 30 days of ME08044. As presented in Table 39, the protein content was increased to 108% and 105% in seed from events-01 and -02, respectively, compared to the population mean, while the oil content was decreased to 95% and 88% of the population mean in events-03 and -04, respectively.

TABLE 39

Oil content (% control) in $T_2$ seed from ME08044 events containing Ceres Clone 300692

|  | Event -01 | Event -02 | Event -03 | Event -04 | Control |
|---|---|---|---|---|---|
| Protein content (% control) in $T_2$ seed | 108 | 105 | 95 | 88 | 100 ± 15* |
| p-value** | 0.094 | 0.215 | 0.112 | <0.01 | N/A |

*Population mean of the protein content in seed from transgenic lines planted within 30 days of ME08044. Variation is presented as standard error of the mean.
**The p-values for $T_2$ seed were calculated using z-scores.

$T_2$ seed from five events of ME08488 containing Ceres Clone 944737 was analyzed for total oil content using FT-NIR spectroscopy as described in Example 2.

The oil content in $T_2$ seed from five events of ME08488 was modulated compared to the mean oil content in seed from transgenic Arabidopsis lines planted within 30 days of ME08488. As presented in Table 40, the protein content was increased to 103% and 107% in seed from events-02 and -04, respectively, compared to the population mean, while the oil content was decreased to 97%, 84%, and 90% of the population mean in events-01, -03, and -05, respectively.

TABLE 40

Oil content (% control) in $T_2$ seed from ME08488 events containing Ceres Clone 944737

|  | Event -01 | Event -02 | Event -03 | Event -04 | Event -05 | Control |
|---|---|---|---|---|---|---|
| Protein content (% control) in $T_2$ seed | 97 | 103 | 84 | 107 | 90 | 100 ± 18* |
| p-value** | 0.48 | 0.248 | 0.104 | 0.148 | 0.746 | N/A |

*Population mean of the protein content in seed from transgenic lines planted within 30 days of ME08488. Variation is presented as standard error of the mean.
**The p-values for $T_2$ seed were calculated using z-scores.

Transgenic plants containing cloned sequences of some of the other functional homologs and/or orthologs of Example 21 were analyzed for total oil content in seeds by FT-NIR spectroscopy. The results were inconclusive.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (590 sequences)

SEQ ID NO: 1 - DNA, 1823 bp, Arabidopsis thaliana
  misc_feature (1)..(1823): Ceres Promoter 21876
gtctcttaaaaaggatgaacaaacacgaaactggtggattatacaaatgtcgccttatacatatatcggttattggccaaaagagctattttaccttatggataatggtgctactatggttggagttggaggtgtagttcaggcttcaccttctggtttaagccctccaatgggtaatggtaaatttccggcaaaaggtcctttgagatcagccatgttttccaatgttgaggtcttatattccaagtatgagaaaggtaaaataaatgcgtttcctatagtggagttgctagatagtagtagatgttatgggctacgaattggtaagagagttcgattttggactagtccactcggatactttttcaattatggtggtcctggaggaatctcttgtggagtttgatatttgcgagtataatctttgaacttgtgtagattgtacccaaaaccgaaaacatatcctatataaatttcattatgagagtaaaattgtttgttttatgtatcatttctcaactgtgattgagttgactattgaaaacatatcttagataagtttcgttatgagagttaatgatgattgatgacatacacactcctttatgatggtgattcaacgttttggagaaaatttatttataatctctcataaattctccgttattagttgaataaaatcttaaatgtctcctttaaccatagcaaaccaacttaaaaatttagattttaaagttaagatggatattgtgattcaacgattaattatcgtaatgcatattgattatgtaaaataaaatctaactaccggaatttattcaataactccattgtgtgactgcatttaaatatatgttttatgtcccattaattaggctgtaatttcgatttatcaatttatatactagtattaatttaattccatagatttatcaaagccaactcatgacggctagggttttccgtcaccttttcgatcatcaagagagtttttttataaaaaaatttatacaattatacaatttcttaaccaaacaacacataattataagctatttaacatttcaaattgaaaaaaaaaatgtatgagaattttgtggatccatttttgtaattctttgttgggtaaattcacaaccaaaaaaatagaaaggcccaaaacgcgtaagggcaaattagtaaaagtagaaccacaaagagaaagcgaaaaccctagacacctcgtagctataagtaccctcgagtcgaccaggattagggtgcgctctcatatttctcacattttcgtagccgcaagactcctttcagattcttacttgcaggttagatattttctctctttagtgtctccgatcttcatcttcttatgattattgtagctgtttagggtttagattcttagttttagctctatattgactgtgattatcgcttattctttgctgttgttatactgcttttgattctctagctttagatccgtttactcgtcgatcaatattgttcctattgagtctgatgtataatcctctgattaattgatagcgtttagttttgatatcgtcttcgcatgttttttatcatgtcgatctgtatctgctctggttatagttgattctgatgtatttggttggtgatgttccttagatttgatatacctgttgtctcgtggtttgatatgatagctcaactggtgatatgtggttttgtttcagtggatctgtgtttgattatattgttgacgttttggttgttgtatggttgatggttgatgtatttttgttgattctgatgtttcgatttttgtttttgttttgacagct

SEQ ID NO: 2 - DNA, 1000 bp, Arabidopsis thaliana
  misc_feature (1)..(1000): Ceres Promoter PT0668
atagagttttactatgcttttggaatctttcttctaatgtgccaactacagagaaatacatgtattaccactaggaatcggaccatatcatagatatcaggattagataactagttctcgtcgctatcacttcgcattaagttctagtaattgttaaagattctaattttttactaaacaaaaactaaatcaacatcaaatatgcaaagtgtgtgttgtccacacaagtgactcaaagtatacgcaggtgggattggaccatattattgcaaatcgtttccgaaccactcatatttctttttttctctcctttttttatccggagaattatggaaccacttcatttcaacttcaaaactaattttttggttcagtgatcaaatacaaaaaaaaaaaaaaagttatagatattaaatagaaaactattccaatcttaaaaatacaaatgaaaccataattttaatttatacaaaactatttaattagctaagggttgtcttaacgtttagaaaataaaaaattatgattgtctgtttaaaattacaatgaatgaataaaaaaaatatgcaatgaatgaaagaataaattttgtacatccgatagaatgagaaaatgaattttgtacaaaccactcaagaattcaaaacaattgtcaaagttttcttctcagccgtgtgtcctcctctcctagccgccacatctcacacactaatgctaaccacgcgatgtaaccgtaagcgctgagtttttgcatttcagatttcacttccaccaaacaaaactcgccacgtcatcaatacgaatcattccgtataaacgtctagattctttacagcctacaatgttctcttctttggtcggccattatttaacgctttgaacctaaatctagcccagccaacgaagaagacgaagcaaatccaaaccaaagttctccattttcgtagcttctttaagctttttcagtatcatagagacacttttttttttttgattagaa

SEQ ID NO: 3 - DNA, 1000 bp, Arabidopsis thaliana
  misc_feature (1)..(1000): Ceres Promoter PT0535
ttagtgaaattatgacattaagtaaggttttcttagttagctaatgtatggctattcaattgttatgttaggctattttagttagtatatgaatttaggcagtctatgcaaatgatttcgttttcattttttcatatgtaaacatcaagatcaagtaacgccattcgagttgatattttttttttaaattagtgtgtgtaaattttggaccgcttatttgagtttgctaatgaagttgcatatatattacgttaaaccataggcaaactaatttgaaacatccgattcgatttcctgtaatttttcttggttaattgaccaaaatcaagatcttcagaaataaaataaaagacgaaagaaagctgtcgcaaagcagattgtgttaaaaaaaagtggattgggctcaaacgcaacttgtccagcccgtgacaattaccctatacgcaagtaagagtaacgtatcactggcaaaagttggtattagttacgatatctttgtcatgggggcatgcatgggcatggcttaagagttaagccttaagaagagtcccacactcgtgactctcatgatcacttgttgtttcttacgggcaaatacatttaactttattcttcatttattcacctatattcttttggataataacttttctctatataaaataacaaacatcgtacgtttcatttatttacaacaagcgatgagaattaaaaggagaccttaattgatgatactcttcttttctctcggttacaacgggattattacagataatgataatctatatggatgctgacgtggaaaaacaaaatttggtgaaacacgtcaattaagcacgacttttccatggctagtggctaagatcgtttcatcacatggctatatcatataatacttggatgaattcaaaataaacgactgagaaaatgtccacgtcacggcgcaccgctttggacttaagtctcctataataaatacaacaccaaacattgcattcca

SEQ ID NO: 4 - DNA, 999 bp, Arabidopsis thaliana
  misc_feature (1)..(999): Ceres Promoter PT0585
tgaagtcatttaatatgagtttgacattaggtaaacctaatctatgagattatagaatgtagcaaaactatcaatgtttcttttccaaaatattttgtggtttttctttttggttcattatgttttgttatttgtgaattattttaatatgaagtaattatattgattttatatgatatacatattattttgatataaaatttaacacttatccattaaaatagcatgggcataatcaaaatcgggactattacgatgaaaaagatagttaaattgtatgataaaataaaatgtgtaagattaaaattttgggttttagaaaattactaaacaaaatatagacaaagtatgttgactattatttaaaatttaaatatcatcaataagatatagttaaagtcattaagtgtatagcaaaatgaaaattctaagattaaaattcgattaaaattttttttactaaattaaatatttaaaaatagggattatcatttactatttacaattctaatatcatgggtaaaaattgataactttttttaaacccgcctatctaggtgggcctaacctagtttactaattactatatgattaacttattaccacttttacttcttcttttttggtcaaattactttattgttttttataaagtcaaattactctttgcattgtaaataatagtagtaactaaaatcttaaaacaaaatattcaacctttcccattattggaatggtaatgtcttcaacaccattgaccaacgttaaggaatgtcttttaatatttttggaacctaaatgctaatactgtataccacaatcacttatgagtattgaagttgagatagaggaggtacaaggagaccttatctgcagaagacaaaaagccatttttagcaaaactaaagaaagaaaaaagattgaaacacaaatatgcgccactcgtagtccacccctatctctttggcaaaagccacttcactctttttccctttttat

SEQ ID NO: 5 - DNA, 1000 bp, Arabidopsis thaliana
  misc_feature (1)..(1000): Ceres Promoter PT0613
ttaatactaacattgtagaaagccacaaaaaagaaattgaaatgtgagtagatgctgagtcagaggtttggtcaatacacaacagctaattgagataatattatacacgtcacgatgacttgttttttctcctcccaacttgttaatttctttattcttaaaattaaaccatcgcaaaaacagaagaacacagctgtttttctcgactcccaatttctattttgctgctaaggacatttcatttcattatttcccaattcaggactccttagattttcctaaatttgttttcctaacttgctctctctcattctaacattttctcatttttttagattatcttgtactttttagtagattattttatcaggttttacaaacatacattgacattctaaaaagggcttctaaaaattcagtgtggaatgctgatatactaaaaaaaggtcatgcaaaattatctacgatttatctaaaattagataatttgccatatataactattaactaataatcgatcctttgattttttgtttagataaaacgaaacagctatatcttttttttttgttatcggattttaatcgaataaaagctgaaaaataacagttatatcttcttcttttttaactaatgaaacagttatatcttaaacaaacaacagaaacagtaaaatattaatgcaaatccgcgtcaagagataaattttaacaaactaataacaattgagataagattagcgcaaaagaaactctaattttagagcgtgtaaacacaaacacgtcttgaaagtaaacgtgaattacacgcttctaaaacgagcgtgagttttggttataacgaagatacggtgaagtgtgacacctttctacgttaatttcagtttgaggacacaactcaagttatgtttgatatctaaggacttgcactgtctccaaatctgcaggaaggactttttgattggatcaatataaataccatctccattctcgtctccttc

SEQ ID NO: 6 - DNA, 351 bp, Arabidopsis thaliana
  misc_feature (1)..(351): Ceres Promoter PT0625
gatcatgatcagtttcaactcgctgtgcccacgtgtcgagagatcggcacgtgcctgagctctcagccgctcataaatacacttgtttagtagcaacagtatactatagtagtcctctcctgtttggcttttagcttgcatcgatggatggatggatggatcgcatgagagggcttcgcgaaggtacggaaccttacacaacgcgtgtcctttctacgtggccatcgtgtaggcgtctcgccatgctacgtgtcccggaggatgtctcgatgccaacccttataaatactgttccattccaatcccatcgccacagccagtgcaaatctgatcgatcaagataatcgagca

SEQ ID NO: 7 - DNA, 1022 bp, Arabidopsis thaliana
  misc_feature (1)..(1022): Ceres Promoter PT0633
cccgatcggccttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttcgttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagtttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctataaacttagtgagaccctcctctgttttactcacaaatatgcaaactagaaaacaatcatcaggaataaagggtttgattacttctattggaaagaaaaaaatctttggaaaaggcctgcaggg

SEQ ID NO: 8 - DNA, 1000 bp, Arabidopsis thaliana
  misc_feature (1)..(1000): Ceres Promoter PT0650
catacttaattctaaaaaaacaacacttatagtttataagcagctcttatgataaaaatctttctgagttatagctctgttaaacttgtattcaccccaaaaacggatgtttcatttcttattttttacttggagtattttattgtaatttgtaaaaaaaaatgtaaagtgggggatatcatgaaaaacaacgtcactttgtttggtcacaatatacatttgataaaataatggtcgtcgcgtgatttagttgatttttgttttatcaaccacgtgtttcacttgatgagtagtttatatagttaacatgattcggccacttcagatttgggtttgcccacatatgacataccgacatagaaggttaaatccacgtgggaaatgccaatattcaatgtttggttttcaaaagagaatcatttctttatatgatctcaaaagtatggaattgaaatgactaatgagcacatgcaattggtgctatcttaaaaaccgaacgtctttgaatttaatttgtttttcaccaaaggtacctaatgaaaccctttcattaaaaaataaaggtaacaaacaaaattttgtattggaaaaaacattttttggaatatataatttggtaatagaattatgagcaaaaaagaaaaagaaaagaaagaataatgagcataataaagcctttacagtattactaattgggccgagcagttttgggctcttgatcatgtctagtaatcttaaacagacgataaagttaactgcaatttagttggttcaggtgagctaccaaatccaaaaatacgcagattaggttcaccgtaccggaacaaaccggatttatcaaaatccttaagttatacgaaatcacgcttttccttcgatttctccgctcttctccactcttcttctctgttctatcgcagacatttttgtttatatgcatacataataataatacactcttgtcaggatttttgattctctctttggttttctcggaaaa

SEQ ID NO: 9 - DNA, 998 bp, Arabidopsis thaliana
  misc_feature (1)..(998): Ceres Promoter PT0660
caagtcaagttccaatattctaaggagaaataatagtatactaaacatacattagagaggttaaacttctttttggatttaagtgtgtatgcataggctatttattcttaagtataactattaactgtagctagatttatacaagaaatacataaaactttatgcatgtgaggtagccatgaatatacgtacatgttgcaatcgattatacatgttgtatttggatttctctatacatgttttaacttgtcattctctaagtatatacataccattaatactgtgggcatgagtttatgataagacttttcttttggagaccagttttgttttcctttccacctatatttgtctataggcttcacggtacactagtttacaagtgtttttatatgttctaaataaaattgagattttccggaacggtatgatctgtttgcaaataaggacgtatatataacagtatcaaatatatttgttgttataaggcaataatatattttctgagatattgcgtgttacaaaaaagaaatatttgttaagaaaaaaaaagatggtcgaaaaaggggagtaggtgggggcggtcggcttttgattagtaataaaagaaaccacacgagtgacctaccgattcgactcaacgagtctaccgagctaacacagattcaactcgctcgagcttcgttttatgacaagttggtttttttttttttttttaattttttcatcttcttgggtttggttgggtcactcttcaggtcaggtgtgtaaaaaagaaagaaagaaaagagagattgttgtgttgtaacccctttgactaaaatctaatgaacttttttaacacaacaaaactccttcagatctgaaagggttcttcttctctcttagtctcttcgtccttttattctccgtcgtcgtttcatgatctgactctctggtcttctcttcttcttcttcttcttctattttttcttacttcgtcactgttgtgtctgaac

SEQ ID NO: 10 - DNA, 1000 bp, Arabidopsis thaliana
  misc_feature (1)..(1000): Ceres Promoter PT0665
aaaaaggatgggtaatgggacctattttccccaacatcccacatgcacacttccctctccattctctcacatttatttctttcattctaatttatccattccgtgtgtaacatattcactaataatctcatctcactaactcattcattgattgtgatatgtttatctagaattagtgttttaacactgtgtctacatatgatttccttttcattgtatgtgaacatgttaactcactaatcattttgtattttcgagttaacatgagtctccacttcggtagactaaagtaaagataggtttgagtataataaagtttaaaatttgctttaaaatcaatatttataaataagtttttatcataagtgatttttgtatgttatattggaccttgtataaacagactacagaagaaaattatttatgagaacttgtaatgttagagtggacctcgtataaactaattatgtgggcttttaccataaactatttatgaaaattattatggcccacaccactataactaaagcccacatatttagcagcccagtttcattgtaagagacatgttcgctctggaactagaattttctggtttttgggtatttgttttcttatgtgtagagaaatgatggtaacgattaaatgttgtgtattacaatttacaatggtaagacgattaatatatttacacacaattttgttgttgctgtaacacgttagtgtgtgtgatgatagaatttcataaagctttaactacgaggggcaaaatgttaattctaaatagttgacagcagaaaaagatatgtatacataatataaggattaaaacgtaaataataataaataaggcgagttaaattaaaaccctgttaaaaccctagcttgaaacacatgtataaaaacacttgcgagcgcagcttcatcgccatcgccattctctctctcatcaaaagcttttctccttgattttcgcattctttagagtcttaacgcaaag

SEQ ID NO: 11 - DNA, 999 bp, Arabidopsis thaliana
  misc_feature (1)..(999): Ceres Promoter PT0672
cagccgtaaatcctccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa

SEQ ID NO: 12 - DNA, 1000 bp, Arabidopsis thaliana
  misc_feature (1)..(1000): Ceres Promoter PT0676
aagatagtacagtttcagtgttttgagaaaaaaagctgaactaaaactaaaatgtttaaggacacaatatttagtttcaattagataattcaacagtttgaacaattttttttttttttttttgaagtcatttatttatacaatgttttaaaacgcattaagcatttaggcagccgacaaacgcctattgtctaactgtaaataggcgcttccacttaggttcatattgcatatttactatatgtgtatagtgacaaaaaccaatatttctcttattttggatgaaggtatagtagttgttaaatgttcaatataattaagcattaatgacaaataaaataaaattaatttagttgataaaaagataatcttataaaaagatcgatgaatagatataatggtttactgaattctatagctcttaccttgcacgactatgtcccaaggagaggaagtaccttaactataattctgaacataattttgtctatcttggtgagtattatatgacctaaaccctttaataagaaaaagtataatactggcgtaacgtaataaattaacacaatcataagttgttgacaagcaaaaaaacatacataatttgtttaatgagatatattagttatagttcttatgtcaaagtacaattatgcctaccaaaattaattaatgatttcaacaggaagtctgagatgatgggccgacgtgtagttacgtttcttgaattgtgagagatggtatttattatactgaagaaaacattatttactaaataaattttcatttcacatcttctgtaatcaatgcgggtagatgaagaagttgttaatacgatggccaaccatatggatctcttttttggcgtttctatatatagtaacctcgactccaaaggcattacgtgactcaataaaatcaagtcttttgtttccttttatccaaaaaaaaaaaaaagtcttgtgtttctcttaggttggttgagaatcatttcatttca

SEQ ID NO: 13 - DNA, 998 bp, Arabidopsis thaliana
  misc_feature (1)..(998): Ceres Promoter PT0678
aattaaatgaaaccgcccctaaattaggagggatttgggtaagtggtaacacattcactggaaacatgtgaagaaaggaggatgtcaagtagctgaaaactcagtatagtaaccaacggcttctcaccaacctttcattaataatttggtcatccctatatttttattcaacattttgtttttcaatagcttagagcaccttaatacctttcagtgtttttttataaaaaaaacaaaaattgggattaatcatcaatccccaaatgtaacgtttacttagattatgttcatttttctatacacacaaatcatattcttttgttttaatcttcgaaaaacgagaggacattaaatacccctaaaaaaggaggggacattactaccaacgtacattaacatgtttgatagcaaacgatttattttgttcgttttgaaaaggggaaagtaatgtgtaaattatgtaaagattaataaacttttatggtatagtaacattttcgaataataagagagggaaaacactcgccattgtcggcaatttagaaccaatattagaagggtttttttagagaaaaaggacttaaaagtttagagaccttaacaacaacttatttagaaatagacatgcttaagttgacaacagcgagtttattttctatatcgaagaaaaatacgaactttttcttaattagatttcgaatgcatgcactatcgagaatcgaccgtcacaagaaaaaactaatatacatactgtacatatctatattcaatattggtggggatgggtttaatgtgtatttataattcatggataaattcacacaataaggtccatgaaactagaaggtaccaaaaataagcattaatgactctttgccacttatatatatgattctctcatagtaccattttattctcccaaacctatcttcttcttcctctcttgtctctctcgctctctctcttctacattgtttcttgaggtcaatctattaaaa

SEQ ID NO: 14 - DNA, 1000 bp, Arabidopsis thaliana
  misc_feature (1)..(1000): Ceres Promoter PT0683
gattgaatgatgagtgtgcacccttgtattactaataaaaaatttagcaacagttataagctaacgtcatccatgagtcattcattagattcactatttgcgttctcaaaaatcgaattgttaaaatttgagaagctctaatatacgagtcaatgagatgtggcaaaagcatgtccttgaccataaaatttcgaggggtcaactcattagataaggacaagaatcaaccaattgaaggcgtcttctataacaagtttctttattactaatattaaagtccaatggggtgagggggagaagaacttaaataaaaggaaataattggtaagtgaataaaatctaaatacgatactagatgattgatttgtgctagtgcatggtattagatcagatatgtgttactattcgaattcaaattggcatattccatgttgttgataagaaaattgtagaagtgtaaaagctgagttactatattcaaactagtggtttacataaagtgagacaacaactgtttcacaaaaatgactataaaatagtaagtagtattaggtcaattgattttaaaattttaatcaaattcaaatttgtgatataatcaaatttgtttatagaaaatgttaagaaatcaattttggcagaactaattcagtgagaaacaatcatttacaaaaacaattttaacattatttaacagtaagatttgacatttaacccgttcgtgtgaacccatcatatctaacatggctctacccatgacgcctccatgccatggacaattttgacagatcagaagttctgaacgtggacgaggtaagaacaccatgatgatacgattggagttagttatgtcgccaccgacatcactgccaatctcattaataaaagtggtactaaatctctaatctctattaactataaatataacaaagaaccaaaagaaagtttcttatctctcttatctttcataatttccaagaaacacaaaccttttctacta

SEQ ID NO: 15 - DNA, 1000 bp, Arabidopsis thaliana
  misc_feature (1)..(1000): Ceres Promoter PT0688
acgttcagaggcatcgcttttgtacaaattgaagcgggtttgttcaatatttaaaataacacaggaaacattcaaatgtattattgatgttgcttaggtttgtgaaatgatatgaaccatatcgtatatattactagatttttcttatatgttttaagggtagtggggctgacctatcattctgtttggcattaccaatcagactatcagagtattcaccattcaggattccataactagaaaaagaaggggtttacattttctcatactgtataattttctactatcagagattttatcgattacattaatctcatagtgattattctgatttataaaaaagttgacaaaataattaaaaccagtattttataacaagattgtctctctcccatggccattattttgacctctgacttatttaaatcttaattaacagcataatactgtattaagcgtatttaaatgaaacaaaataaaagaaaaaaagaacaaaacgaaagagtggaccacatgcgtgtcaagaaaggccggtcgttaccgttaaggtgtgtcgaactgtgattgggccacgttaacggcgtatccaaaagaaagaaagggcacgtgtatagatctaggaaaaaagaaagaatggacggtttagattgtatctaggtaccaggaaatggaacgtcacaccaaacggtacgtgtcggatcctgcccgttgatgctgacggtcagcaacttccccttattcatgcccccctgcccgttaattacgtgtaacccttccatgcgaaaatcaaacccttttttttttttgcgttcttcttcaacttttctttttaaatcaaaccttttctttttaaaatcacattgcatttcctaacgctcaacaaaatctctctctactaatatctctctctctctctctctattgttgaagaagactcataatcggagattgtttgtttttggtttgctctgtaaattggagaagttttgttagagatcaa

SEQ ID NO: 16 - DNA, 1000 bp, Arabidopsis thaliana
  misc_feature (1)..(1000): Ceres Promoter PT0695
aacattttctttaacttactcttaaattttaatagtaagttgatgcatgttatgttgatccgtcttgatcacaaatattgttttatggacgaattctttgacagtaaatggctatagtgactcagcttggagcatcccgatatgaaaacaaagtgcagtattgtgtcgtggtcatcactaacgcactttcctagaactatcgcgcgtgtttgacctatgcaacacaccagatgtcatgaacgtatacttaaatagaaacaatgatatagacaattggctatattctgtcatggaacgcaaaccggataacatgtctattagattcatcggacttgatcatggttatgtcttaatagacgaattctttgttaacgattggttaaaacggctcacgttagagcatcctactatgacttcaaaattgataaatattacatggaaatcactttaattttagttagaaggtagttaatttagatattcttatttaataaattaaaaaatagaagaaaaaaagatgagaagagtttttgtttataaaataagaaatatcttttattgtaattttaaaattaaacaaatttaatttatattaaaattatctttgttttattgttaaggcaataattatttttttggtgggaattgttaaaacaataattagtatactgttaagtggtcctttaataataagataacgtgatttaaaaaagaacgagacaggctaatatagtagagaggaaaaaatacaatttaggcccaataaagcccaatatagagttgtgctcaaacacaggtcttcgccagatttcctatgacgccgtgtgtcaatcatgacgccaagtgtcattcaagaccgtcacgtggcgttgtttctacacataggcgatccatacaaatcagtaacaaacacgaaaagagcattcatatgtacgaaagtagaaaagaagagactctttgtgataaaactaagtaagaaatagcataaaagtaaaaggga

SEQ ID NO: 17 - DNA, 1000 bp, Arabidopsis thaliana
  misc_feature (1)..(1000): Ceres Promoter PT0708
gtttccaaaactagtattctttatttgctctattcattatatttttatatttgtaacgtcccgaccgtctttattaggtttcgacaatcacttctcggaaggtcgtccatcctgaaattactctatcctaaacatgtttaactataaaattctctcgaaacttttgtaacgtatataaccacataaattctcttaaacttatttgcatacaccattatatttctgaaatcgatatgttacaatattatttaatatttagattacttttactgaatcgaattaaatatcaaatcgaaacaaatctaatctaccaaaaataattttgttataaacatttcttgcctagttctacctcatatacattttagttaaagaaagaaatcacaacaattcccataattcaataattaaatccacaaaatcttggagtaagtaagagaaataaaaagatagtatcttaacataaacaattcaaagatgctctctcacacaattcacacacacttacaaaacaaaagacagaaacaatgttttcattcaaatcaaaagaagttataacactagtacaaaaaaagctcaaattctaatagtaactctttttatttcccaattacccaaagattctctctcacttcacaaaactagctttgagagtcgtgttccacaaaatccattaaagctgaaacggttttgctcaccattcaaacaaatacaaaattgcaaaaccccaaattataacaaaataatataaaaattaaaccgctaaaaagagtgaaccaacaaaaatcgccgaatgtgtgtgtaatgagaaaaccgacccatcatcccaatcatctcttcccgtgtcactctcttcctctcccacgtttcttctctcttccctttatgggttttaacttctccttcttcttcttcttcaatcttcagttttcaaattcaacaacaattcacattttgatttcttcatcatctctctctctctcgcttctctctcaaatcg

SEQ ID NO: 18 - DNA, 1000 bp, Arabidopsis thaliana
  misc_feature (1)..(1000): Ceres Promoter PT0710
tagtgcgcgtggggagagggaatggtgaaaccttagtggttaagttatgaggaaaatgataaaaggataaaacaatcaaatgcagcttgaaacggccataacataaagtaccttatggtggtgcgaatatttttgtgtttctttcactcttttattgctgaaagctacgacacttgtcttaatatattgtttccgcaagtcacatgatctactttttatttaacgtctagaaacgccgagatatatgatgattagtatatcacgtctatgcaaattgttagttcgtgtttggccaaaagatatcgagacatgtctgaagaaccgagtctggttttgagatatttcttcaagcattactatacaatagaaaaaggagacacgcgaatatgataatagcaaaaggcataaaaaggcgaaaattaaagaaaaacgtaaagtgatttggcctcaatcaacgggaacgtatcttaattttagaggttcttcttttacttttgagacgagagagtttgcgtctttgcgagctgctttggttgactaaacattatcatattgaaaaccaaaatacaacggaggaatatttgtcacagtttcactttcacattgtttccttaacgtttaatcaaccttgttcaaaatttctatagttgtaatcatcattgtttacaaaattttcgttcaaagatgattttaaataaaattgtgaaagaaaaccttttctgaaataaggattggatgatagtgttaaaagaaaaatatgaactgaggcaaaaagaggagtggtccccggaagattgtgaaatgtgtcatctaaaccagccagacgtagtcacgtgttctctctagctttatgaacttccttagccagcaccatcattgtgattgtagtatatatgtaaccctaccttcatctctcccattttccattctccatatagactcctttacaatatacaaaacctatccaaaagcgaagaagccaagcaaacatattataaaa

SEQ ID NO: 19 - DNA, 1002 bp, Arabidopsis thaliana
  misc_feature (1)..(1002): Ceres Promoter PT0723
gtcatatcttatcaacacgtcaacgatcaaaacctttagcctattaaattcaacggcttagatcaaaacgaaactaggtgggtcccacttttaatatcgtggctgcataacatttcctcgataactgaagccgttgtggtctttctcagaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgttattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttrcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaa

SEQ ID NO: 20 - DNA, 1001 bp, Arabidopsis thaliana
  misc_feature (1)..(1001): Ceres Promoter PT0740
tgtggccactaaagatttacccttaaccgggcccatataagcccacgtcaagtggcgcttatacgctctccgtaagagagccaacatttggtatgtaatgttgcaaattattcttcaagacaataaattcaaatataattcaatattgtccaaatatagtgatgtacttcagttgtgcacatagaaactccactaaaccaacttttagatagatgcattcacaaattttcaacaatgtcgcgaaagtctaatccatcaccagattctaacattttaattattatatttaactatacatactctaatcagcatgagtcaaacgtgtacaatagcccaagcatataataagaccaaagtcaaactcaaataaatgtctccaaactcaaaacttgaaaaagacctaattattacatggtagatatgactttgtcgacaagtaaaccaactaatcctcgaagctaccttctcttcccagttattatgtgtgatcgatttataaatctcttcttctaataacacctatatttttcttatgatgtgaataaatataaaacttttaactttaaaacatatttatccgaaatattgcacttagatttcaaatagataaataatagtactatctaactgatattgaaaagacctaacacggaaaacagttttataaaaaatcccaaatgtgggtaattatcttgatttcttgggggaaacagaaaatggattaagattaatcggagtcgtgtcaagcagctcgttaataactgtagcaagttgactgagtaagcatcaacgtgtcatctccgtaaagcccattatttctagtctcgccgcgtcttctcttccacgtagcacttcactttttctctccttttgtttcctttggaacacaaacgtttctatttataggaataattacgtcgtccgtatctgtgtcggaacatagatccaaattaaaagcgacttacttaattacatatcgttcgtgtttttttcttcaaaaa

SEQ ID NO: 21 - DNA, 1024 bp, Arabidopsis thaliana
  misc_feature (1)..(1024): Ceres Promoter PT0743
tcgattggcccgatcggccccaaaatcaagctgagccgcttcaaacttcagcttttgaaatcacccccaaactcatgtcctcttatcattataactaaaggatctttcattttatttaactcatcgtcttgcactacccaacccaaaggttccaactatacccgaagctttctaaaggtccaaagactttttttttcgagccagactattcaagccaagaaaagccaaaccccacaagccagtacttttcaattccatattataaacttatctgtcttgttttagtcccactaaaaacaacagaatttaatttaggttgagctaaaacccttgacaaaagtgtatagtcgtcgattcagtagcacactcatcactcatcagatttgatagttgacctaaagtatgactactccatttcaactaacaaatgaaaataaaagagacctaagggttagaggattgaaactatactctcaagtcttttatcactaggctactaccagctagttaacttgatggatttaagcaagaaaacgtagaatttatattcgagcagattgtttagctaaaaaagcttgggtttgaaattgccttttctcccatataagcacgtcggttcctaaataactctttctagcggagagtgtctttccaataatttaataaaaatggtgtttgtatatcaaaaaaaaaagaaaaaagaaactgatcgagatagaacgtttgcagttttataaacaatttaaaaaacaaaaaaaattaaactcaatgtattttttattaattcacaaacaataataaatcataggatcgaatatttacacggtatcaaaacctactcgccgctactatataaaaattgaagtcaaatatcaaccgcaattattaaaccagcaagacaataattcataaacttaatataaacataaataaattaatgttacacaacgatatatggtgagggttattactatcttcttcctctcaaaacacatctcctaaccttaagctttagacggcctgc

SEQ ID NO: 22 - DNA, 1000 bp, Arabidopsis thaliana
  misc_feature (1)..(1000): Ceres Promoter PT0758
agctagccacatcagtgaccaaaaaagataattaacaaaccaaataaaataacaaattttgatcatttggaataaaatttataaaaggaacgaaagcgccttctcacgggtcccatccattgaaatatattctctctttttgctctatataataataacgcgtactaatttgtagtatatattattacaaagtcgatatttgattgttttgtgaacgttgatatattaattttcttggatgatgacaaaaaaagtcatagaaagtaacgtgtgaacatagcattaacaaaatacaaacataatatataaccaaatatatgaaaataggataaaatctcattgaatagatcttcttctattcaaatatataaatatttgtttgtctataaaattaacagagcattcacattatctaaaataatagtaaaatcaaaataaaactaaataaaaataactctggttttataacgattgattttaaatattagtttttgttgtaaagagatcattatatatgtctgtaatatttttatactgagttacatgatatttagttattatagcgtaattaactaagataagaaattaactaaagtgatattctgattattattatttttgttaggacacgtacgtggaaaaactaaacactataggttacaaaacggtataataaactcaccattactggaaaatgtttgcatttgactcaataagtaacttattataagttactgatataatgcatagttttgaaattcttaaataaattattttggtttcgcatgaaaatatgaaaggagagaaatttattattgtcacttatatatatatacatcgtaatcattttttcgtgaataattctctctcccattccattatttctcagtatctctctttctttcccttactttattgttgcttttaaaccttcaatttgctcataaaccaaatatataatatcaaaacaaacaaacaaaaaatcagaattcccctaata

SEQ ID NO: 23 - DNA, 921 bp, Arabidopsis thaliana
  misc_feature (1)..(921): Ceres Promoter PT0829
aaagttttgaattattgggaatcaatttcgaagttttgtaattctttgggggctaataggatattttattttcttggtttcgtctattgttgtttttctatttatggttgggcttttagaactctggacaggcccatgtcatatgttttcccttctccttatatttttcatttttcattttgttaaattaatgcataatatccaaaaacaatttaaatttttgaaggaaccctttagttacggctccgaagctttcacaagtgagaatgtgagatcaaagaaggcaaatggaggattttaaaagttaaaatcatcttttatctgcaaaagttgacaatttttttgtatcaaatctaaatcatcaaactctcttaaactacaagagcataacaacctctatgtaatccatgaaataatctgcttgaaggacataacataaatcattatggctagagtgactaacttcaatcaaatcctcttaactctagctcccttacaatggtatcgtaaaacattatgcattagggattgttgtcctaggaaaataaaataaaaatccccacagaccaactaccattttaacttaaaaataagcttcgtccgcgacgaattgttttccatcctaaaaatagaatggtgtaatctgctaatggtttagttccattaacttgcaagttctattgaaagcctaaatgtcaataaagatattaaaattcggagtcaaaagacaaatgaatcaaaagcaacaagacaagtcagctccattcttcactacccatcttttacaataaatcatctctcttttcacaaatttcaaactactctcattgccctttagctttgttatagagccaacactacagagagactcacacacttgtttcaataattaaatctgaatttggctcttcttataaacta

SEQ ID NO: 24 - DNA, 763 bp, Arabidopsis thaliana
  misc_feature (1)..(763): Ceres Promoter PT0837
aactacaagggagacataatatcaccatctggttcctgttatcatctgaagatttcttgttttaccttccagtgataaaatgatccttataatacatatagatatattaaattgctgtattttaagattatagatatataaggtacatgagagtgtttatttaaaaaaattcacttggaattcatgttttgtgatacgttagattggaatccatttgggaaaagaagaatcatctgttcttatgtctcaaattttgacttcattcacttttcttcttgtcttttaagaaagcttccacaatctaactgttcgatgtgaaaactgagattcgagtaagaaaatgtgaactgtgttatactgttttttaattagataatttagattgcactcagataaattaataacattcctcgaatacttttatgtgattggatatattaggtatatctgccaaccaaccaataaactgctatgtttaaacaaattaaataaattagtatatgtttactcaagaataaagaagatagaaaagaaaattctatatgagctaaatttgctggaggaggcatcggacgtgggtaccagacctttccaagcacacgagtagtgcttagccatgtcatgctaacatacaccatttggttcatacaaaatccaaatcaaaatctatttttaaaatcttttgcacacgtctttgaaaaacacctctcatactatagctacggaagcttcaatttcaaggtttgtctaaaagctaacgatt

SEQ ID NO: 25 - DNA, 751 bp, Arabidopsis thaliana
  misc_feature (1)..(751): Ceres Promoter PT0838
atactggtatgcttaaggttgaagccaagatctctgtcttacccaagtaaccactttctattagaagggatcaacactaagaatatggagatttaagcctaagggctaaggcggttctcaacaatacatgatgtgaatacaatcacagacgatttactgaggtttgttgataagatcttgatcagtctctgcatcatctgttcaacaatctcaatctttgactgtttgctttcggagccataaacagaggaatcccttattccctgttataggagcaatacaccaagtattatttccatggctgaaattctcttatggaaacctaattgttccattgaagctgtaaaatcgaatctggtgaatattctcgagcaaagccgcatgctaattatgtcaattcagaagagtttgattaggagactcgaagcgagtttgatgatctttcttgatgttcaactccgattgtaagggtataattgacttttcatgtattacggctccaccacctgacactaaggcactctttgtccatctcgttggtatcatcggattcggatggtaaaaataaaaagagcagaggaaacttgttactcatgcaagcttctcaggtgccacgtcactccattacgtgtcatcttcacacaccatctcgctcaaaaccgatctcatttttcaaaccttaaaggcagaagcaactgattaagttaacactcttgagaagctctcgattaagcttgaacttggaggatca

SEQ ID NO: 26 - DNA, 669 bp, Arabidopsis thaliana
  misc_feature (1)..(669): Ceres Promoter PT0848
tctctttaaatcagttaactaaccgtttatatatttacgataaggtttgaagagattattgataaaataatacatttcataatcccgcgttcaaccgtttaaagtaacatttaagttgactatatctaattttttttccattaaatatggagctggtaaactttatcaacttctaaaaagtgtaacaacaaaaattaggtcaatcacaattctgttttttttattattttggattgacttccaattgcaaatagtcttagtgatcaccattatcatacatatatacatcaagtaggtttcatcatgatataccacaaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagcttttaaaaatatttcaaaacaagcctctttgtgtttgtctatatatatacacgtaataagaaggtgaatgaatctcacagcttacttgttctaaggcttccaataacgaaaacagta

SEQ ID NO: 27 - DNA, 702 bp, Arabidopsis thaliana
  misc_feature (1)..(702): Ceres Promoter PT0863
cgggaaacgacaatctgatctctagtccagtcgattggcccgatcggccgattataaacttacatgagacaagtataaataattattataaacttattaagtttaagatcaaggcttttgtgcaatgtatcaatgaatgttagatgtgatatgatgaaagcaatgttttaaacacatacatagtcattgatcggaatgtgtgttattagaaatgcatgcctaagccgatagggttatctatgtttggtcttggacattatagccaaatttcgaatctaattcttccaatatatatttttttttttttgcttagggccactactagtattgcttatcaattttaagagctcatgaaaatgcaacaatatagtagttgcaaatccttgtttcaagagaaatcaaagggccacttgtgaattgaataataataatatttgcaaataacctttcactaaaccataccaacaaaaccacacagatttggcaaagacataacctttgggagacgtgaaaaggctcaaaatttgacaattgtccttacaaattcgctcattagtgcaattgtgagatttgtttgcatccaaatccaattcataactcacactcgtctcaaattcgaaaaggcctgcagggccagtgcactgggatccaacaatgtcctccgactcgtccaagatcaagaggaagcggaaccgcaccgcg

SEQ ID NO: 28 - DNA, 435 bp, Arabidopsis thaliana
  misc_feature (1)..(435): Ceres Promoter PT0879
ttctaggaagactggtcaagctaagctgtttctgttttttgtttttgtactttactttttgtttgctagtgggaactgggtttattgggccttgaagttgataaaagatgaataaaagacatatcgcctaaagcccatatgagaagcagaagacaaaaacctccaactttgggcataaattttgattatagttaaaagtccagacccaatttggcacctggcttagttacgattctaaggcatgacacctgcctaatatgtttattacagaaaataaagagaatcagctaggtgtcccttattgaacacattaacaaactccaacgacactacgtgtcttcgtgactcttactatatccaaaaacctatagctaaagctgaattttccatgattagtatagtcccaaccaaaaaaatactgaagaaggcataagc

SEQ ID NO: 29 - DNA, 397 bp, Arabidopsis thaliana
  misc_feature (1)..(397): Ceres Promoter PT0886
agtgtatttgaaaacgacattgaagaattaatatatttttttttaattttagttttttatagtacaaatattaaaacaaacaatcctaccatatcataacatttgtaaataacattttaagttttgttttgagttttaattaattttctatgacaaaaaaatgaagtcaatagactaagtgaatcatatagtataaataaacacaatttaaatagtttcaaataaatttagaaagaataaaacaaatagaaatcagaaggtgtctgtttcctcctcgcaacatacgatcaaagagaaacaacttgaccctttacattgctcaagagctcatctcttccctctacaaaaatggccgcacgtctccaaccttctcccaactccttcttccgccatcatc

SEQ ID NO: 30 - DNA, 1024 bp, Arabidopsis thaliana
  misc_feature (1)..(1024): Ceres Promoter YP0007
agcagaacaactatatttattgtgtcacataaatctgagatcatttataaccaccaaagaacctatacacagtaaatgacaaatgtatctccctctatctctattgcccatatgtagatgctaaagtaagatttctcttttttttaatgtacttttttttgtataaagtatattccataagaaaaaggaaaagcttgtttatggatcaattgaccccaaaaaaagtttttagatcaaagcccaatataaaaaaaaaacacagtagtgacacaaaggaacttaaataaaccatgaattgatctataaacagtagagatcgataaggcgaacattttccatgtgaagtgtcttctttcatctataatatttttgacatccaataatttcctctataatatcattcacataattgatagaaacattatgttagaattgtccacatcatttgagctgtaatatattctgttttaacaaattatatggtagttgcttaatcttatgtccatcttcttctatgcatcgttttcgcgcctagttgtccagtccatttcaactacctacctctaattcttatcttaaaacaacattttttaatttaagtattatgctcaaagactaactagatagaaaaccgttattaaacattaaacgaattaaaagtcttacatggaaaatgtaggtttataaaccacgagttatgattgacaataaaaaaaatgcaaatcatcaatcaaaagagacttgagtgcgactctatatcaaccattgcaattaaaattatctatcacaaaaattttagacagattaagttaatttagtctaaattcactaatttattttctataattagtaattaactatatttatttatttacacattttctgataatttagaaatttgcatgaataacaaatataagattttggaaattagtagcaaatttaattaataattatttttgcctaaatgaaccaaactataaaacctccacatacaccagtcatcaaatttacagagacaaca

SEQ ID NO: 31 - DNA, 1000 bp, Arabidopsis thaliana
  misc_feature (1)..(1000): Ceres Promoter YP0008
ctcgagagatgaagtcttagtaatgtttgaacaaacaataatcacgttttccatcaaattcgagcatttaaagtttatattactacatgccccaagatgataccgtccatctcatccgaaaatatttctgaaattgcgctaagacaacaatgtttgctcaaattcgatcatttaaagtttacaaatctctcatcaatcttacaaacttctcacactaaacagaggtacatattttcttataaagacaaaaggttcgaacagctggcttctcaactcgagttgtttgtcagggcctctcttcactaactacaagttggtacttcaaatattggtggctagcttcacgtgatattgtctacaaattaaacccatgaaaaagctgcattaattgttccaagtgaaccctgaggagtgtcaatagtctttgctttagtgtgatcattaaaccaaatctctaaattcctaatttgtactaacatttggaacgtatttcctactcttctccctgctccaactcccaaaaataagattagttagatttctataactaatatacatgtatactcccaaaaacagtaaaaccatattaataaagctaattttgcatagatttatttcggtaaaccggcggttcaagttggggaaaaaaaagacaaacggtctaaagtcatccaaagacaaaaaaccaaagacaagttgagagagacgagaccaatcacaacattgcttcgtagattgcgtgacatcatccttgacggctactttcatttgtgtcttatttggataaaacgcacgtgtttaattcacgaaccttcatagcaataagaaatttccattactttcatattttcaactttttttattacccattacatgcttaaaatattaattcacaagtctttgtcaaaattcaatattttccaggttcatgaaccctttttatctcaatctactctataatatctccctataaattacaacaaaacctctttatttttca

SEQ ID NO: 32 - DNA, 999 bp, Arabidopsis thaliana
  misc_feature (1)..(999): Ceres Promoter YP0019
gatataagtagaatcattttttgccgccgtttctcgctaacacaccgaaaactgaatcaaatctcctagctcttctacgcaaaatcgagtgcatcgacaatggcggaacgtggtgtcgaacgtggtggagatcgcggcgatttcggacgtggattcggtggtcgcggcggtggaagaggtggtccgagaggtcgtggtcgccgtgcaggtcgtgctccagaggaggagaaatgggtgccagtgactaagcttggtcgtctcgtaaaggaaggtaagatcacaaagattgagcagatctacctccattctctcccagtcaaggagtaccagatcatagatttactcgtcggtccttcattgaaagacgaagtgatgaaaatcatgccggttcaaaaacaaaccagagccggtcagagaacgagattcaaggccttcatcgtcgtcggagatagtaacggtcacgtcggattaggagtcaaatgctccaaggaagttgcgacggcgatcagaggcgcgatcattctcgcgaaattgtctgtggttccgatacgaagaggttattggggtaacaagattggaaaaccacatacggttccgtgtaaggtaaccgggaaatgtggatctgttactgtacgtatggttccagctccgagaggttctggtattgtggcggctagagttcctaagaaggttcttcaattcgctggaattgatgatgtctttacttcttctagaggatccaccaaaactcttggaaacttcgtcaaggtatgtactttcacaatggctgttttggtttgatgaactctgaattaggcagtgaaaaagtaatcattaccagttaagtgaatttatattgaagattaggatttagctgattgtattggtttgagcatgtgagtttgtgtttaagattgcttgaattgaaatgctttaggttgtttgattacgctaaattctgactaatgtaattcaaattgttgttgtttttttttggtc

SEQ ID NO: 33 - DNA, 1024 bp, Arabidopsis thaliana
  misc_feature (1)..(1024): Ceres Promoter YP0028
gtcagtgaagtcgattggtagtacttgaaacacttggttggtttcatgtatttggcctatatataaacaaacatcgtaattatatacggatttttttcggaattttacgccatatctgtaagtatatataacatgcatgtcgttttcaaattcatatgatgaacgatccacgtaagtgctactactcctacaatattgcatgagagagatatgtatttataaattttattttgaagaagaaataagagggaaggttacttgggtggatcgatgtgaaaacaaaagaagaaaaagcgaaacccactaagccattacatgatatcgaccttcttatctttttcctctttattttatttttctcatcttctttttgtcaggacttttttctacttaatgaaacctccaaactatctaactaatacactcccatgtagaataaagaaaattatataagatattgttgatattttgtaactagaaaatatatttgctctgtaatttttcgtaagttaaatcaacattttaaagtagaaacaaatattactgcaaaaagtaggatcattatttttgtccaaaatctcagttagctatagggttgtagtaaaaacaaaacacattcttgatttgccccaaaaaataaagagagagaagaatattgttcaaaagtggtctcttctctctctaattatgttttcactaaacccaattagattcaaacagtctacaaagtccaaaagataaacatgggacaacaattcgatgcaaaaaatcctcttttcatgctctttttttattctctagtcttttaaattactaataaaaactcacaaatccaccaaacccattctctacaactcaccttcatctagatttacccactcccaccgagaaacacaagaaaaaaaatatacatatataaatatacaagacaacacatgatgctgatgcaatatacacaacaaagtattaaatcttagatattgtgggtctccctttcttctattcattttcttattcattaaaa

SEQ ID NO: 34 - DNA, 1024 bp, Arabidopsis thaliana
  misc_feature (1)..(1024): Ceres Promoter YP0039
ccgttcgagtatttgaaaatttcgggtacacccgcctaaataggcggaccttatctagtatatatatacatttgaactatattgtttactttttagttgatttaggctatgtcatgacattgacataaatctacctgttatttatcacgtgtaattcgtgtaaagtgtaaactagaaagttcaaatacgtatttgtttttgttctgttatataggattgtcatagttgtaaatctacaatttattacaacatgaataagtacacaagcaatgtaattggatttaattgctaaactctttacatggtcaatctaaatttgataagaaatacgtcacatattactaagactgatagtttttttgttgtcaccaattatttttgttaaattgacgaaaacaattccaaaaactcaaatgtacaaaatcatacagtctcacaaacatctcatagagaaagatataaatctcccatatgggaacgataacacgaggtcgaaatactattcgtaaaactaaaacgccttagttataaatcgttagttgtaaccgcggtcgagaatacatacagatccacgaaactactactacacatgctgctgaattggaatttggaaaagaccatcttctttaggaagagctcacccaatgagtgacaaaggtgtcggtggcttgttttctacccatatgtatacatcaaatggtagtttcattaacgtttggttttgagaaaagtaagactttggctagtagctaggttcgtatataataaactcttttgagaaagttcatcactggtggaaaatgttaaaccggttttttctcattttttccgccatgttaaccaccggtttaaaaagaccgtaacacattgaaagattaataagggtatatttgtaattacggtttgctggcaatttttaattattattttaattagagaaaatagagaagccctatcaatgtacatggtatatatataaaaggcaaaaccctagaaaacgatactattcgactcagccgtcctt

SEQ ID NO: 35 - DNA, 1024 bp, Arabidopsis thaliana
  misc_feature (1)..(1024): Ceres Promoter YP0050
aatctgatctctagtccagtcgattggtacttgagggaaacatcatatttttaaaccttgtctcagtaagctaacacacaccccttgtgattacttatccatgtttatccacaagaatgcagttggattgagatattttcttctttgttgaaatcaggcctcaaggtgttcatgtggtctgcaaaaaaattcccaaaaataaagatagtgacatctgaaatcgataatggattagacgaagagtttcgtgttattccttggtatgggcgggtttggggacagatattttggcacagacgaggactaggccactgtggtcctgcagcattaggtgtcccttccatgtcctgcattacattttattgatggattcatcaccctatctactacaacggctacacaaactatgaagagttttgtttactaataaatgcccaagtgaggggtcgatcgaacccgggacacgtttttcagtttaccatatagaattatccttggaacccttgatactccatagaacatcaccacctctgttgtcatctcaggaatccaggttcaaacctagtctctctctccctagtgggaggtatatggccactgggccaatgatgacaaaatgcaaaaaaaataaaatacatttgggttcattatctaaaatatctcttgtgtttgtaagttttggttgcacactcgtgtggttgaagtgtgtgtgagaggtactatacaatacactctgcttttgttttgtacctatctctttctcttctccacatatccaagactttggggataaagctgagatcattggttgccatttggttgtgtagaagcaatcacccatttgctttatccgaggttgataaatttcctcgggttctccttctgacacgtatgacaaattctaatagtatattcctcgtagatattacctatatattctcaatagttgcaggtacttaaggctttgtcttggcatcctcgtcctcttcagcaaaactcgtctctcttgcactccaaaaagcaa

SEQ ID NO: 36 - DNA, 999 bp, Arabidopsis thaliana
  misc_feature (1)..(999): Ceres Promoter YP0086
cttatcctttaacaatgaacaggtttttagaggtagcttgatgattcctgcacatgtgatcttggcttcaggcttaattttccaggtaaagcattatgagatactcttatatctcttacatacttttgagataatgcacaagaacttcataactatatgctttagtttctgcatttgacactgccaaattcattaatctctaatatctttgttgttgatctttggtagacatgggtactagaaaaagcaaactacaccaaggtaaaatacttttgtacaaacataaactcgttatcacggaacatcaatggagtgtatatctaacggagtgtagaaacatttgattattgcaggaagctatctcaggatattatcggtttatatggaatctcttctacgcagagtatctgttattccccttcctctagctttcaatttcatggtgaggatatgcagttttctttgtatatcattcttcttcttctttgtagcttggagtcaaaatcggttccttcatgtacatacatcaaggatatgtccttctgaatttttatatcttgcaataaaaatgcttgtaccaattgaaacaccagctttttgagttctatgatcactgacttggttctaaccaaaaaaaaaaaaatgtttaatttacatatctaaaagtaggtttagggaaacctaaacagtaaaatatttgtatattattcgaatttcactcatcataaaaacttaaattgcaccataaaattttgttttactattaatgatgtaatttgtgtaacttaagataaaaataatattccgtaagttaaccggctaaaaccacgtataaaccagggaacctgttaaaccggttctttactggataaagaaatgaaagcccatgtagacagctccattagagcccaaaccctaaatttctcatctatataaaaggagtgacattagggtttttgttcgtcctcttaaagcttctcgttttctctgccgtctctc

SEQ ID NO: 37 - DNA, 1024 bp, Arabidopsis thaliana
  misc_feature (1)..(1024): Ceres Promoter YP0088
tcgattgggattactacttcatctagtaaggttctgaaaacgtttgttgttgataaggaagattcgtctcaggttattactgttgatcttcaaggtttgtgattgtgacgcttatacatgtgctgaaactgtggtgtttatttattgaaaacaaaaaaaaagtctctcttgtagtttcattgtactaaatagaaaacaagaaacgtttttttctttaatcttctacattgataatattggatcaaaggattgtttctgcaagacacaacacaaacatacttatactagtttacttctactaagtactaactacatacccatacacacacttgcacctagactttacttctagacatcattaccctaaggtagaaccaagcttacaagcaagttttaccgacaactcttacattacaactctagtctgtagtctttaacgtagacttactaactagtcattagtggtttaattttttaaattttcatccatatgtttttgttgtagatataaactaaagtcggtcacatttaataattgtcattatgtccgcgtaaaagtcaattcagctattggacatttatgaaatgtaagattttctctctcatttccccgtgcgtgaagacatgcattggtttttctgtaataatcaacaaatccaaaccccttttcgatctttatttggacattgttagagacaaaatttctctatagtctttttcctaatttgataccatgtttttgtttctgcacaaatttactcactggtttaactaactatccacttatttatgattttaccattaggcgtcagctagccctagtcaaatttgtaaacaagccaagctatctacataaatcgagatgtcattaacgttaatcgtcgttaattcgaatttgaaaacatagatagctttagcagtacaatgggcaatggtaagaagaatagcaaaaggcccaatatttggtttgcagaaattaaagccttaaaaaaaagcccacagatatttgtcaaagaaccctaat

SEQ ID NO: 38 - DNA, 1024 bp, Arabidopsis thaliana
  misc_feature (1)..(1024): Ceres Promoter YP0092
aaagattgagttgagagagatggtggagacgcagaacagacaaagggagtttaccatatagtgctctaaagggcaatgagattgcagtgatgtggctatccggggaatcatcgcaggttattccttcccatgagcaacaatcaatggatgggttccaattcagaggagaaacagaagaagaaacgtttccagagaaccacagtagggattctcgatcttgcgagttgcagagagcctctgaaactgcaatagaaaggacactgatgaaaagaacacactgaaggagtatgccaatcatgtgaaaactcagagcttgtattggtcttgtggttgatgaagttctcacaaaacctttggctttgaatctcccctcattagtcatggtgagaacaagaacaagacgagaaacagacaaagaagatgaaaaaacttgttggccagtgttgactaagggggaatagccccagacataacaaaattagacttgtcgtacatctttaatatttttttatctgtttctttgtcctgacgctttcattattcctgtgatcaattttctcataccattggtccatcgttaatcctttcttaatttcattttctacgtaacatgagaggagaccaagtcctatgagaacagttgacgtaacagtggttgttaagttaagttaaaaagaggaagctagtgagagtgaccgttaggtagagaagtgagatctttaaccactcttctttctctctctctctgcttttttcgtcgtctttcacatctactgttcgcaaactctcttatgcttccaataatggtgataccaattgagacttgcaggagaatctcctcttctccacactctatcaactggtcagccatggaatggtcgtttcagtttcaatattcctggattctttttaaggattcctgtttctcttctgttcctggtatattcttaacgacgaaattagtatcggatcctggtaatacattttgaagcttttaagtaccattgcactgggatccaacaat

SEQ ID NO: 39 - DNA, 1020 bp, Arabidopsis thaliana
  misc_feature (1)..(1020): Ceres Promoter YP0096
gaggtcagtgagtcgattggtgcaaaattgaaaaattgaagggtgaaacaaatttaaagataatatctattaaatcctctaattttaaaaatttagcaaaaattgtattttcttatggatctgttagttcacacgtatcttaattagtaccaaatcatatctaatgattagtgataaaactagttagatatctatatgtgtctttaccatttaacttgaatccttcttcttttttttacgtaaacaacttgaatccttcgttaatacataaatttaaagcattttttctttaattctattgatcggtatatatttactataagttttagctcatatgcaatttcaaatgatatgcttttaaattttgtctaggtgtgatagttgtatctttaacataaatcttatagcaaaattatacttgatattctaaatttatctatttgctcttgtgaacctcatattagtctagagaaactttgaaatcctttcaattagttgtatgtccaatacatttttactaacatttattagtctttttaattaagattattgttagaaaaaaaaagattttttaaaaataaataatatgttttagatacaatgtgagttaggcttcttatattttaaaaaataaatttatttcatacttaaaaatagtttggaatttcaatttatttggctgaataccataaaatatgtcaatttgaaccttatacccattgactatttggtgttagaaaccctttaacaaaaaaaaactatttggtgttagatatcaaaataaaaaaagtttaaccattggtttcttatattgaattggatattgttacatgtattaaagtttttttggtttaattttgaaacgttgatagaaactattaagtttaagtttggtagtatatttatttgtggaaaatttaattgccattaaatataacgtcaactttttttggttttttttgagaagttacgttgtgattttgatttcctatataaaagttagattacgtcattttttaa

SEQ ID NO: 40 - DNA, 1000 bp, Arabidopsis thaliana
  misc_feature (1)..(1000): Ceres Promoter YP0097
ttcatctttatatttaagagtttaaaaactgcaacttttgtttttctttcactaagtcttatggccacagttaattaaaagcagatgaaaggtggtccaatggaaaaggagaatgtgattgggctagttgggagagttctgatgtctagtgttgggtacacgtgtccgtcagttacacatagcattaaatcagacggcatgtcattattcaaatctagttcacatagtacgactaatagctgataaattaatgattatacagcatatgaattatgaattcaaaaaaaaaaaaaaattgaaaatgttaaggagatgctatattttacaaaattcatcgcaatgctttctactaatttgctaagtggtcttctccagttagtcttgtcgattccaagcgatattattaaatcttgaagcatcgctcaaagcattatagcttaagataaccaaattgttattaaaaacacctagtgaaatttttaaattaaaacaattttgatatctttgtaatatctaatactactctttctgtgtctaaaaggattaattttcaaaaatttcacacatattaaaaaaaaaaaaaaattactagctaaacaattttcaataatcataaaacaatagtaacttaataatttttttttattttcaaaatagtccttcaagtttacaattcattttagtattataatcaacaaaatttgtattaaaaagttggaaaattaatctttgtggaacaaaaaaatctagaaatcattttttagaattagagagaggtttgataaaaaaaaataaaaaaaaatagagagaggtagtacatactaaacgatgtgatactactattgacaaaatcttaattctcagtttagtagaataaactagaaggaatgaatgaagtaaatgcgaatccaactactaacaaaccctacttagtcatcatattttcccatatgaaatccctatataaacccatcatcatctcccacttttttcatatcca

SEQ ID NO: 41 - DNA, 1004 bp, Arabidopsis thaliana
  misc_feature (1)..(1004): Ceres Promoter YP0101
ttctcgttctctagaatattgctggaccggattaggtcaatattattgggccagattagatattgaattgtcgacgttgcttacgttacgttatatcttgtttaagaattaaacctatcgacttagtcttaattaagaaaacattgccttaaattctctggtctgcgaccgtttttttgaccgttaacccctaattaaagaaacaaaataattatagaaagagcactgaaatgtgattattttaacagtactcttatgagaaaattcgtactttttagttttttttttgtacaaatctctaagaaaaacactactactaattaagaaacgtttcaaacaattttattttcgttggctcataatctttctttctcggtccgggactaaccgttggcaaaaaaaaaaaaaaagttgacaataattattaaagcgtaaatcatacctctcaaataaaaacttgaatttggaaacaaagacaactaaaaaactcgaatttaagagaattcctaaaatcaagtgaagtatcatcacttggtaaaatttcataaccgttggcttctatttctatgtgtgccttggtttgcaggagataatatttcatttccaaccaatgatattcgtacacatagtcaaacaaatgtttgtctttgttattatattgagaaagaaacaagaaagagagagagagatagataagacgaaggaagtgaagcttccaagcgcccaccgttaaaaatctcgtgtgcaagtttcaaatacaagtggccggtggtctccataatttgatcgtcatccaattaaaaaggaagaaaaagcgtgttttatacaagaaaactcattaaaatagcaagtctagaaatatctcaacactaatctaccacgtctattacacacacacacacacacacttgatcttaatttattttcaagattcaagaaaatacccattccattaccacaacttgaccacacgcctatatataaaacataaaagccctttcccc

SEQ ID NO: 42 - DNA, 1000 bp, Arabidopsis thaliana
  misc_feature (1)..(1000): Ceres Promoter YP0102
atttggttgataacgttttcactcgactaattatatacttcagaaggatagtaatagaataccaaaataattaaatgattggttagtgccttagtggagactttttaaccgattctaatagactaatgatgtagctaagcatttatttgggatcatcactgtttgaaaacgtgaaatgtgataaaagttatgaaacgattaaaatataaaataaccgtacaaaacattatgtaccgtttttttctctgttcttttggcgatttggtttagttcgttacactctaaatgttattgcagatatatatataatgatgcatttgcatctgaggaacatataattccggttaacacttccaaatcttatatccgtctaggtagggattttataaatcatttgtgtcatcatgcgttatgcttgtcggctttgaccataacgcagagatatagaactagcttttacttaacttttagatttattatttgatctagagttaagtggagatatatagtgtttttgttagattattggtggatgtgagagtttgtctttagtttcaagttgagaatataaggcaagaggagactctgaggcaatcagaggttttgattggcaaaatatccaaaaggcccaaaccaagtcgaagcccatctcgtacaaaaaaagaaagagatctgtaagaaaaaatattctttgatattcttacaaaaataagtgtaaaacttttattagtcaaaatcttcaatctttaaaaactctcatcactcctacgaaagcgcgtgagagttatgagacattccttaatagcattactcacaagtcacaagttcaaaacgtctgactgaaacagaaacaagcctttgttgaagtcttgaagaagagacattagtactcgtcgtatagccataaaaggtaatatacgaaatttcttcgctaatctcttcaccttcctctacgcgtttcactttcactttataaatccaaatctcccttcgaaaacat

SEQ ID NO: 43 - DNA, 1004 bp, Arabidopsis thaliana
  misc_feature (1)..(1004): Ceres Promoter YP0103
gttttgaagaacaatctggatcgaaatctaacataaggtcatcgtattcaagttacgcagtcaaggacttgacatcatcctactctggtctgaggttaccacttccaaagatgggatttttcgactcggtatgcttcctaagaaattcgttttattgaacctagcaaatatcttgtaatgtaagattcctgagatgatgaagaaaaaacaaacttttgttacagcaggagaacggagagaaagaaaacagagaaccaaatgctcttgaagcaaacagaagaagaagacacaaatccaaacttgagacttcttctacaccagaaaaccgcagcattctgggacaacgcaaaacacgaaagtgaaacgggcaatgatatatatgtcttgggtgcgttacaaggcatcgtttgcaactgttgagttggataagtcaactgtcttcttttcctttggttgtagtagctgccttttttttcctttgttgctttaagaaatagcccgaaaaaaagaatgttctacatttcggagcagaaaactaaccgaatgagtttttggtcggatcatcggatcgatcagatatattttgagttacgaactgttataaaaaaagccataattttgtgttgagtttgcaaaataccttataacttgttatttgagattgcacctccatatatattaattcgtaagagtatttattaagtaagctttagtataaatccttttttcctttaaagtaagttaatgttctactaaataatagtaaagttgaagaaccgctccgtttttacaccatgcacgtgttatctaacaaagaaaatatggtacacctaatggctaatgcaaaggacaacacaatgaaactaacttgactctgtgttatagaaacccatagacatctgcatacatcctagtatttgtataaattggactcaaattcctgaggacaatcatagcaaacaatcacatcatcgcaatatacataaacaaaagaggaagaaaaa

SEQ ID NO: 44 - DNA, 1003 bp, Arabidopsis thaliana
  misc_feature (1)..(1003): Ceres Promoter YP0107
taacaatccttgggaacattgcatccatagatatccggttaagatcgatctttgaactcataaaaactagtagattggttggttggtttccatgtaccagaaggcttaccctattagttgaaagttgaaactttgttccctactcaattcctagttgtgtaaatgtatgtatatgtaatgtgtataaaacgtagtacttaaatgactaggagtggttcttgagaccgatgagagatgggagcagaactaaagatgatgacataattaagaacgaatttgaaaggctcttaggtttgaatcctattcgagaatgtttttgtcaaagatagtggcgattttgaaccaaagaaaacatttaaaaaatcagtatccggttacgttcatgcaaatagaaagtggtctaggatctgattgtaattttagacttaaagagtctcttaagattcaatcctggctgtgtacaaaactacaaataatctattttagactatttgggccttaactaaacttccactccattatttactgaggttagagaatagacttgcgaataaacacattccccgagaaatactcatgatcccataattagtcggagggtatgccaatcagatctaagaacacacattccctcaaattttaatgcacatgtaatcatagtttagcacaattcaaaaataatgtagtattaaagacagaaatttgtagacttttttttggcgttaaaagaagactaagtttatacgtacattttattttaagtggaaaaccgaaattttccatcgaaatatatgaatttagtatatatatttctgcaatgtactattttgctattttggcaactttcagtggactactactttattacaatgtgtatggatgcatgagtttgagtatacacatgtctaaatgcatgctttgtaaaacgtaacggaccacaaaagaggatccatacaaatacatctcatagcttcctccattattttccgacacaaacagagca

SEQ ID NO: 45 - DNA, 1024 bp, Arabidopsis thaliana
  misc_feature (1)..(1024): Ceres Promoter YP0110
gggatgcggttccgcttcctcttgatcttggacgagtcggaggacattgttggatcccagtgcaatggtaatataaaacaagaaaacaagagattttataggacaatcactaaatgacatttaattgattaaacatttattcattaataattgtatgttactaacttcaacatttaataattttgtttaagatacgtttacatcagagactattaatatttttacaggttgtaactttaaactttgtcttgaatcgaacatgactatagattttgggcaaacttaaagataacaacatttccgttttttttcaaattattacaaatcaaactgatatattagacacaacacgattacacgtaatgaaaaaagaaaaagataaaaagataaaagaagggatcgattctgtttggtctggtttagtgagattcaaagttaagctcttcctttcaagacatgccttcttaaaccgggaatgtgaacgtttgtaatgtagtccgtccagttaatgcttccaacatcaaatccaaattctctcttctcgtcctctgacatattctccattaatctctggggtattgctgttatcaaatctgtaaaagaaaccaaaaaaaaaagatgaaaactttgcgggtaccggttttgtctgctctaagaattagaatgttaatgagttctgtcttaccttccaccatagaaagtgtatggctcataaatagtagcaaggtgtttggcttgttcaacagatttcttgcatataaactttagcttctgcatcatcttactatccactgaactcataccactcatcaacccactccgttcttgagcatctctccacaaatgatccgagaaatcatcaacggaattgaaaagtttcatcaaacgcaccataataggatcacctttagagtccatgcatggagatgttttgtagtggttataaagaagctccgctaagtcttcgaaaaccagcgggtttatcgccgaagaagcgatctgatacacgtttatttcaggttcc

SEQ ID NO: 46 - DNA, 1024 bp, Arabidopsis thaliana
  misc_feature (1)..(1024): Ceres Promoter YP0111
cgattggatttagtctatacattatagggcgcaagtttgtggatttaagaattatataaaaacttgaaatatatagtttttatgcattctcctcttgtgtaatacataaaccaaatatgagataggttaatctgtatttcagataatattaaattccaaacaatatttttacttgttataagaaggcaattaatatctctctgttaatggcaagtggtaccaagtagtattaaactattaatgcaatggaagagtactgttggaaattataatcctctatcacacattcaaacagatctcctgaaatcttctcttccaaacttgtacttctctgatccaaatgtaggctccaaaatatagacatttaccatttactaagtccacaactcctttcttgtctccttcaaaaatgactcttgtgtaaccaccatatgactccgacagttcggcattgccatgatgagagcttaaaaattcaccttcctgagcatttcaagtcttcactcccttagcttgacctgaaccaagataaaatgcctttgtcgtcccgtaatatccatcctgctttggacggcatcatagttacattcgatccatcctatttacaatgttattttagtattaaaaacatgacaataaatttgttgttaaacatattcaaatacaatatgattggatttataagtaattgtaatatgaaatgtccttagtaatatgttaaaaaatacatagatacacacacgtactaaaagaggcaacgcgggagatgtcattagaggaagaactaggaagcagagcgttcatgcaaaatgctaccaaaaacgttaatgcaatatctcaactaatcagcacagtccatttcatactgagaatgtaaaaaccaatcagcatcgtccattttttcatctaattatttgttaactcttaattggccacaacttccaaccacatgacgctctttctattccctttatatattcccatctcaaatgttcttggagacacaaaatatcataaacatata

SEQ ID NO: 47 - DNA, 996 bp, Arabidopsis thaliana
  misc_feature (1)..(996): Ceres Promoter YP0115
gtcgattggatgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttac

SEQ ID NO: 48 - DNA, 1024 bp, Arabidopsis thaliana
  misc_feature (1)..(1024): Ceres Promoter YP0117
gtcagtgagtcgattggatcacagtcctttatgataaaacaaactcataattattccaccgacaacatgcgttttaaattattttttcttaaattatattatattatattgatatcaacctagctaaaataattcggatggcgaaatcggacaatttttaatagaaaaaatgggtatgaagatagtctatgattccgttcttagcgactagagggacctgctcaaatctcccgggtgatacgcgatgtcaagctcaatagaaccccacaaccgacgagaccgagaaatccttgatttgggctagaagattttgaaataaatttaatatattctaagtaacttgcttaaattttttttcaaactctaaagacataactaacataaagtaaaaaaaaaaaagttaatacatgggaagaaaaaaattaaactaatgattagctctctaacgtgtttaatctcgtatcaagtttttttttaaaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactaatagtcactttggaactgagtagatatttgcatcttgagttaccatggactcaaaagtccaaaaagagaccccgagtgaaaatgctaccaacttaataacaaagaagcatttacagcggtcaaaaagtatctataaatgtttacacaacagtagtcataagcaccattg

SEQ ID NO: 49 - DNA, 1000 bp, Arabidopsis thaliana
  misc_feature (1)..(1000): Ceres Promoter YP0119
taccaaaaataaggagtttccaaaagatggttctgatgagaaacagagcccatccctctccttttccccttcccatgaaagaaatcggatggtcctccttcaatgtcctccacctactcttctcttctttctttttttctttcttattattaaccatttaattaatttccccttcaatttcagtttctagttctgtaaaaagaaaatacacatctcacttatagatatccatatctatttatatgcatgtatagagaataaaaaagtgtgagtttctaggtatgttgagtatgtgctgtttggacaattgttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggtaaggttgtgaatattatgcaccattcattaaccctaaaaataagagatttaaaataaatgtttcttctttctctgattcttgtgtaaccaattcatgggtttgatatgtttcttggttattgcttatcaacaaagagatttgatcattataaagtagattaataactcttaaacacacaaagtttctttattttttagttacatccctaattctagaccagaacatggatttgatctatttcttggttatgtattcttgatcaggaaaagggatttgatcatcaagattagccttctctctctctctctagatatctttcttgaatttagaaatctttatttaattatttggtgatgtcatatataggatcaa

SEQ ID NO: 50 - DNA, 999 bp, Arabidopsis thaliana
  misc_feature (1)..(999): Ceres Promoter YP0120
tagtttttgatttaatctacgtttttcttaatcataaatgggtaattattagtttttgcaaaatcaaaatccaaaaattgttctaaacactgcaaccatttaaggcctatatcactcagaaaatttctggtgggagaactaatcgtttgtcctttctaaatctcacatattagaatttagaattagtgtgctacataagaatattagttcagctcggaacaactattttttggtaaaacagagaacttaaacaaatgcattattttatcaacatgcattttgaattgaatataaaatttcataattgtaaagacataaattacataaaattttacatgaaaaaatagatatagaaagaaaatgaaactaactgatgatatgctctctaaattttttaatctcataacaagaattcaaattaattagttcatatttttggttaatataacatttacctgtctaagttggaactttcatttttttctgttttgtttagtcagtattcttaatgtgaaacggaaagttgaatttattcaaacttaaattcaatagcattaattaaaggcgaaagctattatctctacatgtggttcaaactagacatccaatttaattagcttattgacgttgaaatgttttccaaaactactatagtttggcaatttgaaagatgcatcagaactactcagacaggtaaaagtagaacctctagctgtgtgaattgtatgttagtccataaagaacatcttgtaaacttcatacttaagatatatattacaatatatacttgaatggtagataaaaacgattagtctgattgctagcatactcacaactatttggaaatgagtaagatattggcattctagagttactactatggagacaaaagtcgaataaaagagacctcacgtgaaaatgttacgagctagtaaaaaaagcatttacactaacggtaaaaaaagtatctataaatgtttacacaaggtagtagtcatt

SEQ ID NO: 51 - DNA, 999 bp, Arabidopsis thaliana
  misc_feature (1)..(999): Ceres Promoter YP0121
ttggattttttttttgttgagtcagcagaccatctaatctctctttttccaccacagcctgctttctatgaagcatttgggcttacggttgtggaatcaatgacttgtgcactcccaacgtttgctacctgtcatggtggacccgcagagattatcgaaaacggagtttctgggttccacattgacccatatcatccagaccaggttgcagctaccttggtcagcttctttgagacctgtaacaccaatccaaatcattgggttaaaatctctgaaggagggctcaagcgaatctatgaaaggttggcccattctccttgacaggcttaacaatacaacttgtatcgcttcaacaagatgatggcttaataaggatttttgcatgtataggtacacatggaagaagtactcagagagactgcttaccctggctggagtctatgcattctggaaacatgtgtctaagctcgaaaggagagaaacacgacgttacctagagatgttttactcattgaaatttcgtgatttggttagtgtaacccactgttattcttttgatgtctacatctactttacttacattattcttttcttcggtttgcaggccaattcaatcccgctggcaacagatgagaactgatcatgacagggtaggattttatttcctgcactttctttagatcttttgtttgtgttatcttgaataaaaattgttgggttttgtttccttcagtggtttgattttggacttatttgtgttaatgttgttttggctgttctcttaatatcaataacaaataaatttactggttggtatctaagatctaacaatagttactatttttagaggtaaagacaccaaccttgttatattggtcagagagctaaaaccttgacttgttgggaaaacaaaactctaatgacagaaaatctgacatgatgccttataattcacagcctcatgttctacataaatcctaacaatagcactttgtttct

SEQ ID NO: 52 - DNA, 1004 bp, Arabidopsis thaliana
  misc_feature (1)..(1004): Ceres Promoter YP0128
gataaactgataatggaaaagaacaaagaaaccagtttttaactatttgcatatgtaatttatttgttgcaaattatatttagttaaaatgtttcctctatttatatatatatatatcagtcaagcactatgtataagaaatgtcaatttataaatttttacatgtcctttaacagaaagaaaatgaatttttacatgtcattcatagagagtcactcgtttatttcttatatagagaataacacactcacatgcatatgcatgcaatatgatacattttatgacaaagataatcaacggaaacggtcaagacataatttgataaacaacttgcacgatgcacagatctgatcaaatatataactctttaacatatccaaaatattcaaaaagaaaaactcgatccaaactagcaacatcacgctcacgcggtaggctaaaaatttattaatctccaaaagtctttcttatgaacactgcaaacacaacaacttgaaaagtcatataggtttagatgatgacgcgtattggctatcgcttaccggagtggctcataaatacaataaacaatacgtaaaagtcaaagtcaaatatatttagtcaactataaccattaatcgggcaaaacctttagctgtcaaaacaacgtgaaaacgatatttgtatatatcatcaagaatcagtagataagagaatgatttaatcccctgactattacaattttggtgtaataaacagtctctattggtttttattctttgttttaatttctcatgacctatagagagaattaggtagtttcgaaaattggctaatcaacttttgaaaactactgtctactttgcttaaattctctacacttagtttcggataagataattgtcggactaatagttaatcccttgacaatctttgatattataaaaggtttagttaatctcttctctatataaatattcatacaccagctttcaaaaatatataatccaaacaccaaaaacaaa

SEQ ID NO: 53 - DNA, 1001 bp, Arabidopsis thaliana
  misc_feature (1)..(1001): Ceres Promoter YP0137
gtggcacatgctgaaaccccgagcatctctccggaagacacgcgtcgttcgctccaaagaaaacagtcacagctgccggagaatctccgccgtcttcttctgccaccggaaaaactctctccaccactttcagtgcccacctcgtgttatatccactgtatcctcgtagcaccatatcagcctaataaaattttatgtatcaaattttaagacatagccgaaactacactatactagacaataataatatgatttgtttcctgaaaaattatggtttcatgagaaacattaatcatctataaaacaaattagctatggcatcgaagagttatcaatcaaaactgatgaatctttacttaatatatacaacatatctttaccttgcggcggagaagatcggcgagagaagcaccccagccaccgtcactaaaggattcttcagtgatggaatcaccaaagagaaaaaccttccgtctcatcatcttccacacaatcttcttgagaaaatctgagagataagaaaggtgtagtggttttgctgaagtgatcgtgtttgatttagtaaagaaatgctttatttattgttgggggaaacataaataaataaagtaaaagtggatgcactaaatgctttcacccactaatcaccgacctttcatggtttattgtgaaatacactcatagatagacatacaataccttatgtacgtaaataacattttatttgtcgacacttatgtaagtaacgcatagattattttctatgtgattgccactctcagactctcagtttcaaccaataataacaataactacaacaacattaatcataaacatatgctctggtttacaattaaagcttagattaagaaactgtaacaacgttacagaaaaaaaatgttatttacgttttgtaagattagtctctagaatcatcaccgttttttatatattaatgattctttcttatatataaaacctttctcgaaatacccatgaaa

SEQ ID NO: 54 - DNA, 1001 bp, Arabidopsis thaliana
  misc_feature (1)..(1001): Ceres Promoter YP0143
atacaacagatggcagatatcgagttaaatacgtgaatcagccgttacgatattttaaaactagaaaattatttaaaaatattgcaaaataccatttaatttcattgttcataaaaaaaagaaattcaaaaacttaaaaactgattcaaaaatttggattaattctcattaacagtcttcaacactacaacaacatgtttctaatttattttatattttaataattaaacaatatatacgtctgcacattgttgctccgacataatctagtataaaaatagttgcagcatatgtgaaaagcaagcagcatttatcactcaatacttttaattttatctgttgtatgtattaaggttttgtagctttaagaaaacgcttataatataaaataacttctaaaagatatttcatgcgtatacaataaatatttgtgaaaaaacatttcgaaaacgtgtacaatatataaactattgtgttatcttttgacattcaaacaaatgttgacaatgtaattttatccatgatatgattggccaattagctgcgaggtaaaaatccgtatacgagtaaaagtaagataaaatttcgcaagaagatttttagcaggaaatctaagacaagtgtcatgaacgtgtcaatcaacaaacgaaaaggagaattatagaatccagattcgacgtaccacattaataaatatcaaaacattttatgttattttatttttgctctggcagttacactctttttcattgctccaataaaaaaatcactcgcatgcatgcatatatatacaccatagtaaactccgcctcttcttcattttaaaagtatcagtttacactgacacaatccttaactattttcctttgttcttcttcatctttattacacatttttttcaaggtaacaaataatctttttaagtcacttttatactctttaaatcttagattgatatatgaatgcatgttaatatttcaagatttataggtctaccaaac

SEQ ID NO: 55 - DNA, 1003 bp, Arabidopsis thaliana
  misc_feature (1)..(1003): Ceres Promoter YP0144
aaacgttgcaagattattgattgtgagaaagagtgctcaaggtagtactgatttctgtaaagctcacggtggtgggaaacgatgttcttggggagatgggaaatgtgagaaaatttgctagaggaaagaagcggtttatgcgctgcgcataacactattatgtctcgggagaacaaagatggaagcaagagcggtttgattggaccgggactctttagtggccttgtttttggctctacttctgatcattctcagtctggagctagcgctgtctctgattgtactgattctgttgaacgaatacagtttgagaataggcagaagaacaagaagatgatgataccgatgcaggttctagtaccttcatcaatgaaatctccaagtaattcacatgaaggagaaacaaacatctatgacttcatggttccggaggagagagttcacggcggtgggctagtaatgtctttacttggtggctccattgatcgaaactgaaagccatttatggtaaaagtgtcacattctcagcaaaaacctgtgtaaagctgtaaaatgtgtgggaatctccgaatctgtttgtagccggttacgttatgctggatcaaaaactcaagatttgttggatattgttatgctggatcggtggtgaaaccacttcccggttgctaaataaataaacgtttttgttttataatctttttcactaaacggcagtatgggcctttagtgggcttcctttaagcgaccaatacaatcgtcgcaccggaatctactaccatttataggtttattcatgtaaaacctcggaaaatttgagagccacaacggtcaagagacaaaaacaacttgaagataaagggataaggaaggcttcctacatgatggacaacatttctttccacacaaattctcataataaaaatcttataatacaaatacttacgtcataatcattcaatctagtccccatgttttaaggtcctgtttcttgtctgatacaaat

SEQ ID NO: 56 - DNA, 1004 bp, Arabidopsis thaliana
  misc_feature (1)..(1004): Ceres Promoter YP0156
ttggtttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctgatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacactttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcggaggcacagtttaaagttcgagtgtaacagtttctaaggca

SEQ ID NO: 57 - DNA, 1000 bp, Arabidopsis thaliana
  misc_feature (1)..(1000): Ceres Promoter YP0158
ttattagattaatagattgcattgcattgcttgtgctttcaatttacaaattgtctcccaactccatcgacacatctctttttgtgtatataagattcagacttgttatattttttttataaatatgttattagcatcttaagttaaattgattttttatatctgcattaaggattacacgactatatttgcgattgtgtgttggttaaaatataatttaggattgtctttaactacatttaggattatatgactatatttggttaaatataaaatctagctgtgattattagtattcaaaaataagtagcctaaccaattaaaacaacggctattggggcaaattagaacattttagtgtgtccaaaatataatggtcattaggtcatattcctcctagcttcatcgcagcataattgaatgattgccttatttagaagagcttttccactttcccaaaatctaggtgggatctttttgttttgaccttcatttttcttgtttaccatttttagctaaattatttacgattacaaaagatatcaaaagttggatcataatacaatttatagacttactgtagaaaattcgtatgtacaagtacaacaaattcttcataataaattttgaaaattctattacaaatgttgtaagaaatagaatttgaaatatatataaactaaggagaaaaaaaaagagaacatgcattgctctagtcagagtggaccaacatcaacgagataagataacataaaaaccaactcaccataactaaaaacatcccaagagatccaacgattcatatcaaacacaaaaacatcgaacgatcagatttaaaccatctctggtatctccaaaacacaaacacttttttttttcttttgtctgaatggaacaaaagcatgcgacatctctgtgtctttatcttctctctcctcttcttgaaaaactgaacctttaattctttcttcacatctcctttagctttctgaagctgcta

SEQ ID NO: 58 - DNA, 1005 bp, Arabidopsis thaliana
  misc_feature (1)..(1005): Ceres Promoter YP0188
gattggtatgaaatttcggagaccaacaaaaaaaactttattgagcttggagtgaagctatatatatggggcaagatcataatatgtttatatcggccttttcgttaactgaaaataatagttttgagaaatatatcaaatggtaaacagacatcatctttgaaaaataccatcaatgaagttaatattgttattggcatatggtttacccatcttaattttaatgcaaccaaacaaacaagaaacaaaaactgtataagatacaaggtgttttacgattttccgtcttaaaaccgaaatatttttgttcctacgactttaaacggactttgcttaagttgtgtgcatgtaagctcgtcgtccctcgattgtcatcaacattcaccaatatcagcctctatcacacgagtgaaggtggtgattcggcttaatgaaaacagagaaatatttcaatatgattcctattaaattttaaatcttttttctcaatctctagattttcattaaaagcatcatgatttttttccactatgttcatatatctctatcacagttttaggtacattgtagaaattggataagatacgtcatacgtctaacatgaatttggtctagcaaggaaggtttgagataataagtgaaaagaaaacacaagataataaattataatttataaatgctttatagtattgaaaaataagatgattttttttttttttaataccggattggctgatccacttatgatgactcaaatgttattaagtttcaagacaatttatgatgacacaaatcacaatgagtcaatagtagccacgaagccagaaaaaaaaaatgtactacaaaaagataatgatagtacaaaatgatacgtcgtactgccacatgtacgacacaactcgattaccaaaaagcagagccatccaaccataaaactcaaaacacacagattccactggcgtgtgctctcctcacttcactcgtccttgaaacttgaggtactga

SEQ ID NO: 59 - DNA, 1002 bp, Arabidopsis thaliana
  misc_feature (1)..(1002): Ceres Promoter YP0190
taaatagtgacattggtaagaagaaaaaaaacactattaaatagtgaaaaaatggtttataactctcttaattaacattacttattattgctagcacctaaaatctcccacaaaatatttgttgtaaaacacaaatttacaaaatgattttgtttttaaattagtaacacatgttcatatatacgttaataagaacataccctatatgattttatataaaaaaatttctttgagacgtcttattcttttttctttaataatatgcaattgtgagagtttggatttgaatggtagcattagaagcaaacttgaaccaaacatatttcatgaagtcaaacttgaaccaatgtgatcactaatcacagtgttcgcagtgtaaggcatcagaaaatagaagaagggacatagctatgaatcatataatcttgacacatgttttataggttttaggtgtgtatgctaacaaaaaatgagacagctttcttctaatagacttaatatttgggctaaatgtaccacagttgtgaatttcttacaaaaatgggccgagctacaaaaaactacaggcccactctcaactcttatcaaacgacagcgttttacttttttaaaagcacacactttttgtttggtgtcggtgacggtgagtttcgtccgctcttcctttaaattgaagcaacggttttgatccgatcaaatccaacggtgctgattacacaaagcccgagacgaaaacgttgactattaagttaggttttaatctcagccgttaatctacaaatcaacggttccctgtaaaacgaatcttccttccttcttcacttccgcgtcttctctctcaatcacctcaaaaaaatcgatttcatcaaaatattcacccgcccgaatttgactctccgatcatcgtctccgaatctagatcgacgagatcaaaaccctagaaatctaaatcggaatgagaaattgattttgatacgaattagggatctgtgtgttgaggac

SEQ ID NO: 60 - DNA, 995 bp, Arabidopsis thaliana
  misc_feature (1)..(995): Ceres Promoter YP0212
agtcgattggtacactcttaatttaattagagtaagagatcaacaaaaatatagaattttctttatatcgaagtgctacgaccttatatatatagaaaaaaaagcataggtgaatctctaaattgagattgtgctgtagtaaacatattaagtttttagtttttttaagaaatgaatctttttgttgattaattcaaactagtagtcattaagattccggagattccaatttagaaaagtcaaagattcaaagaacaagtccaggtccacatgttgaatccgattcatcatccactcatccttcatatcttcctccaccgtctccgcccaaaaaatcaataacaataaaaaatcctaaaaaaacatatttgattttgaaaaaactttatcatatattatattaattaaatagttatccgatgactcatcctatggtcagggccttgctgtctctgacgtccttaattatcattatttttaaatttgtctctctcagaaaattacgccacaatcttcctctttcccttttccgaaaacagctaatatttgtggacctaaactaaataacgtagcctctagattttatataattactaatactatatgctactacttgttattatttactccaatcatatatgataccaatcaagaatcactacataagtagaaaactttgcaatgagtccattaattaaaattaagaataaacttaaaattttatggtattttaagattccctttggattgtaatgacaagaaatcagcaaattagtcgtaactcgtaagaataaacaagatcaatttttactttctttacaaagattccgttgtaattttagaaatttttttttgtcactgtttttttatagattaatttatctgcatcaatccgattaagaagtgtacacatgggcatctatatatatctaacaggtaaaacgtgtatgtacatgcataaggttttacgtgcttctataaatatatgtggcagt

SEQ ID NO: 61 - DNA, 1024 bp, Arabidopsis thaliana
  misc_feature (1)..(1024): Ceres Promoter YP0214
ccagtcgattggcgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactacttaattagtcgttagttataggactttttttttgtttgggcctagttataggatcataaggtaaaaatgaagaatgaatattagattagtaggagctaatgatggagttaagtatgcacgtgtaagaactgggaagtgaaacctcctgtatggtgaagaaactatacaacaaagccctttgttggtgtatacgtattaatttttattcttttatcacaagcgatacgtatcttaagacataataaatatatatcttactcataataaatatcttaagatatatatacagtatacacctgtatatatataataaataggcatatagtagaaattaatatgagttgttgttgttgcaaatatataaatcaatcaaaagatttaaaacccaccattcaatcttggtaagtaacgaaaaaaaagggaagcaagaagaaccacagaaaagggggctaacaactagacacgtagatcttcatctgcccgtccatctaacctaccacactctcatcttctttttcccgtgtcagtttgttatataagctctcactctccggtatatttccccattgcactgga

SEQ ID NO: 62 - DNA, 911 bp, Arabidopsis thaliana
  misc_feature (1)..(911): Ceres Promoter YP0263
atctagctgtggattccaccaaaattctggcagggccatgatctaaaaactgagactgcgcgtgttgttttgcagtgatttgtatttcatatttgcaccatcctacacagtccacttggtatcgtaaccaaacataaggagaacctaattacattattgttttaatttcgtcaaactggtttttaccttttagttacatagttgattcttcatttgttttagtagttatggagcacaataatgtgcaacaaagaaagatcatagtggattaatatgttgagaggtcagaaattcttggttaacaaaaaaaagttacaaggactgagattttgggtgggagaaagccatagcttttaaaacatgattgaacttaaaagtgatgttatggtttgaggggaaaaaggttgatgtcaactaagatagttgaagtaatgtcttaaactaaagtaaaccaccggtccaaccgtggtccggaagcatctctggtatgatttatcctaaaaatcaaaatagtagaaacatactttaaatatatacattgatcggacgaaaattgtaaactagtatagtttcaaaaactagttgaacaggttatgtaccttaaacatttatttcaaacttaaacactaaagaacatatatgaatagaagtttatataaattactatatatctaccataaatctcttataattatgatgtcacgatgaggaagtgttgaaacgttaaaatgccaaaatataagcatgcgacggaattttggcagaagattgtagagttgtaatctgtcgcaatcattactcgtgctagcatttttcattttcccttcatttgtggataacgcacgatataacattctacacaccaacaagattctataaaaacgcaaaggttgtctccatagaatatcgtc

SEQ ID NO: 63 - DNA, 999 bp, Arabidopsis thaliana
  misc_feature (1)..(999): Ceres Promoter YP0275
aaacattaatatgtagtaactatgggcgtatgctttactttttaaaatgggcctatgctataattgaatgacaaggattaaacaactaataaaattgtagatgggttaagatgacttatttttttacttaccaatttataaatgggcttcgatgtactgaaatatatcgcgcctattaacgaggccattcaacgaatgttttaagggccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcacttttaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaattagtttttacagaagaaaagaaaaca

SEQ ID NO: 64 - DNA, 981 bp, Arabidopsis thaliana
  misc_feature (1)..(981): Ceres Promoter YP0285
gggattatatatgatagacgattgtatttgcgggacattgagatgtttccgaaaatagtcatcaaatatcaaaccagaatttgatgtgaaaacactaattaaaacatataattgacaactagactatatcatttgttaagttgagcgttgaaagaaaatgaaagagtgtagactgtagtacgtatgagtttcccaaaagatggtgcttgaatattattgggaagagactttggttggttcggttgaatgaagatttttacctgccatgttgatagagaaaggcaaataaatgtaggggtcgatgtctaacgtaaagactggatcaaccaagagtcctcctcctcgtcttcaccaaaaaaaaagagtcctcctcgtggaaacttatttcttctccagccaagatctcatctcatctcttcactctatgaaatataaaggaatcttatggtttttctaaaaactatagtacgtctatataccaaaggaaacaatataaaatcagttaatctgataaattttgagtaaataataaagttaactttgtacttacctatatcaaactaattcacaaaataaagtaataataacaaagaatttttagtagatccacaatatacacacacactatgagaaatcataatagagaattttaatgattttgtctaactcatagcaacaagtcgctttggccgagtggttaaggcgtgtgcctgctaagtacatgggctctgcccgcgagagttcgaatctctcaggcgacgtttcttttgttttcggccataaaggaaaaagcccaattaacacgtctcgcttataagcccataaagcaaacaatgggctgtctctgtctcactcacacacgcgttttcctactttttgactatttttataaccggcgggtctgacttaattagggttttctttaataatcagacactctctcactcgtttcgtcaacattgaacacagacaaaaccgcgt

SEQ ID NO: 65 - DNA, 996 bp, Arabidopsis thaliana
  misc_feature (1)..(996): Ceres Promoter YP0286
gaaaacaatcataggttacgctattatcatcgaaaggtatgtgatgcatattcccattgaaccagatttccatatattttatttgtaaagtgataatgaatcacaagatgattcaatattaaaaatgggtaactcactttgacgtgtagtacgtggaagaatagttagctatcacgcatacatatatctatgaataagtgtgtatgacataagaaactaaaatatttacctaaagtccagttactcatactgatttcatgcatatatgtattatttatttatttttaataaagaagcgattggtgttttcatagaaatcatgatagattgataggtatttcagttccacaaatctagatctgtgtgctatacatgcatgtattaattttttccccttaaatcatttcagttgataatattgctctttgttccaactttagaaaaggtatgaaccaacctgacgattaacaagtaaacattaattaatctttatatgagataaaaccgaggatatatatgattgtgttgctgtctattgatgatgtgtcgatattatgcttgttgtaccaatgctcgagccgagcgtgatcgatgccttgacaaactatatatgtttcccgaattaattaagttttgtatcttaattagaataacatttttatacaatgtaatttctcaagcagacaagatatgtatcctatattaattactatatatgaattgccgggcacctaccaggatgtttcaaatacgagagcccattagtttccacgtaaatcacaatgacgcgacaaaatctagaatcgtgtcaaaactctatcaatacaataatatatatttcaagggcaatttcgacttctcctcaactcaatgattcaacgccatgaatctctatataaaggctacaacaccacaaaggatcatcagtcatcacaaccacattaactcttcaccactatctctcaatctctcgtttcatttcttgacgcgtgaaaa

SEQ ID NO: 66 - DNA, 1000 bp, Arabidopsis thaliana
  misc_feature (1)..(1000): Ceres Promoter YP0337
taatttttttatttttggaactaacacttattagtttaggtttccatcacctatttaattcgtaattcttatacatgcatataatagagatacatatatacaaatttatgatcatttttgcacaacatgtgatctcattcattagtatgcattatgcgaaaacctcgacgcgcaaaagacacgtaatagctaataatgttactcatttataatgattgaagcaagacgaaaacaacaacatatatatcaaattgtaaactagatatttcttaaaagtgaaaaaaaacaaagaaatataaaggacaattttgagtcagtctcttaatattaaaacatatatacataaataagcacaaacgtggttacctgtcttcatgcaatgtggactttagtttatctaatcaaaatcaaaataaaaggtgtaatagttctcgtcatttttcaaattttaaaaatcagaaccaagtgatttttgtttgagtattgatccattgtttaaacaatttaacacagtatatacgtctcttgagatgttgacatgatgataaaatacgagatcgtctcttggttttcgaattttgaactttaatagttttcttttttagggaaactttaatagttgtttatcataagattagtcacctaatggttacgttgcagtaccgaaccaattttttacccttttttctaaatgtggtcgtggcataatttccaaaagagatccaaaacccggtttgctcaactgataagccggtcggttctggtttgaaaaacaagaaataatctgaaagtgtgaaacagcaacgtgtctcggtgtttcatgagccacctgccacctcattcacgtcggtcattttgtcgtttcacggttcacgctctagacacgtgctctgtccccaccatgactttcgctgccgactcgcttcgctttgcaaactcaaacatgtgtgtatatgtaagtttcatcctaataagcatctcttaccacattaattaaaaa

SEQ ID NO: 67 - DNA, 1000 bp, Arabidopsis thaliana
  misc_feature (1)..(1000): Ceres Promoter YP0356
ttagttcattgaaacgtcaactttttacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaatttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacct

SEQ ID NO: 68 - DNA, 1000 bp, Arabidopsis thaliana
  misc_feature (1)..(1000): Ceres Promoter YP0374
aagacacccgtaaatgttgtcatgtagaagaaactagaaacgttaaacgcatcaaatcaagaaattaaattgaaggtaatttttaacgccgcctttcaaatattcttcctaggagaggctacaagacgcgtatttctttcgaattctccaaaccattaccattttgatatataataccgacatgccgttgataaagtttgtatgcaaatcgttcattgggtatgagcaaatgccatccattggttcttgtaattaaatggtccaaaaatagtttgttcccactactagttactaatttgtatcactctgcaaaataatcatgatataaacgtatgtgctatttctaattaaaactcaaaagtaatcaatgtacaatgcagagatgaccataaaagaacattaaaacactacttccactaaatctatggggtgccttggcaaggcaattgaataaggagaatgcatcaagatgatatagaaaatgctattcagtttataacattaatgttttggcggaaaattttctatatattagacctttctgtaaaaaaaaaaaaatgatgtagaaaatgctattatgtttcaaaaatttcgcactagtataatacggaacattgtagtttacactgctcattaccatgaaaaccaaggcagtatataccaacattaataaactaaatcgcgatttctagcacccccattaattaattttactattatacattctctttgcttctcgaaataataaacttctctatatcattctacataataaataagaaagaaatcgacaagatctaaatttagatctattcagctttttcgcctgagaagccaaaattgtgaatagaagaaagcagtcgtcatcttcccacgtttggacgaaataaaacataacaataataaaataataaatcaaatatataaatccctaatttgtctttattactccacaattttctatgtgtatatatatacccacctctctcttgtgtatttg

SEQ ID NO: 69 - DNA, 998 bp, Arabidopsis thaliana
  misc_feature (1)..(998): Ceres Promoter YP0377
tataaaccattcctataacaccatatttaaacataacaatgaattgcttggatttcaaactttattaaatttggattttaaattttaatttgattgaattatacccccttaattggataaattcaaatatgtcaactttttttttgtaagatttttttatggaaaaaaaaattgattattcactaaaaagatgacaggttacttataatttaatatatgtaaaccctaaaaagaagaaaatagtttctgttttcactttaggtcttattatctaaacttctttaagaaaatcgcaataaattggtttgagttctaactttaaacacattaatatttgtgtgctatttaaaaaataatttacaaaaaaaaaaacaaattgacagaaaatatcaggttttgtaataagatatttcctgataaatatttagggaatataacatatcaaaagattcaaattctgaaaatcaagaatggtagacatgtgaaagttgtcatcaatatggtccacttttctttgctctataacccaaaattgaccctgacagtcaacttgtacacgcggccaaacctttttataatcatgctatttatttccttcatttttattctatttgctatctaactgatttttcattaacatgataccagaaatgaatttagatggattaattcttttccatccacgacatctggaaacacttatctcctaattaaccttactttttttttagtttgtgtgctccttcataaaatctatattgtttaaaacaaaggtcaataaatataaatatggataagtataataaatctttattggatatttctttttttaaaaaagaaataaatcttttttggatattttcgtggcagcatcataatgagagactacgtcgaaaccgctggcaaccacttttgccgcgtttaatttctttctgaggcttatataaatagatcaaaggggaaagtgagatataatacagacaaaacaagagaaaaga

SEQ ID NO: 70 - DNA, 999 bp, Arabidopsis thaliana
  misc_feature (1)..(999): Ceres Promoter YP0380
acaagtaccattcacttttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagag

SEQ ID NO: 71 - DNA, 1000 bp, Arabidopsis thaliana
  misc_feature (1)..(1000): Ceres Promoter YP0381
cacggtcaaagtattgctaacatggtcattacattgaaaaagaaaattaattgtctttactcatgtttattctatacaaataaaaatattaaccaaccatcgcactaacaaaatagaaatcttattctaatcacttaattgttgacaattaaatcattgaaaaatacacttaaatgtcaaatattcgttttgcatacttttcaatttaaatacatttaaagttcgacaagttgcgtttactatcatagaaaactaaatctcctaccaaagcgaaatgaaactactaaagcgacaggcaggttacataacctaacaaatctccacgtgtcaattaccaagagaaaaaaagagaagataagcggaacacgtggtagcacaaaaaagataatgtgatttaaattaaaaaacaaaaacaaagacacgtgacgacctgacgctgcaacatcccaccttacaacgtaataaccactgaacataagacacgtgtacgatcttgtctttgttttctcgatgaaaaccacgtgggtgctcaaagtccttgggtcagagtcttccatgattccacgtgtcgttaatgcaccaaacaagggtactttcggtattttggcttccgcaaattagacaaaacagctttttgtttgattgatttttctcttctctttttccatctaaattctctttgggctcttaatttctttttgagtgttcgttcgagatttgtcggagattttttcggtaaatgttgaaattttgtgggatttttttttatttctttattaaacttttttttattgaatttataaaaagggaaggtcgtcattaatcgaagaaatggaatcttccaaaatttgatattttgctgttttcttgggatttgaattgctctttatcatcaagaatctgttaaaatttctaatctaaaatctaagttgagaaaaagagagatctctaatttaaccggaattaatattctccgaccgaagttattatgttgcaggct

SEQ ID NO: 72 - DNA, 999 bp, Arabidopsis thaliana
  misc_feature (1)..(999): Ceres Promoter YP0384
tttaaaaaattggataaaacaccgataaaaattcacatttgcaaattttattcagtcggaatatatatttgaaacaagttttgaaatccattggacgattaaaattcattgttgagaggataaatatggatttgttcatctgaaccatgtcgttgattagtgattgactaccatgaaaaatatgttatgaaaagtataacaacttttgataaatcacatttattaacaataaatcaagacaaaatatgtcaacaataatagtagtagaagatattaattcaaattcatccgtaacaacaaaaaatcataccacaattaagtgtacagaaaaaccttttggatatatttattgtcgcttttcaatgattttcgtgaaaaggatatatttgtgtaaaataagaaggatcttgacgggtgtaaaaacatgcacaattcttaatttagaccaatcagaagacaacacgaacacttctttattataagctattaaacaaaatcttgcctattttgcttagaataatatgaagagtgactcatcagggagtggaaaatatctcaggatttgcttttagctctaacatgtcaaactatctagatgccaacaacacaaagtgcaaattcttttaatatgaaaacaacaataatatttctaatagaaaattaaaaagggaaataaaatatttttttaaaatatacaaaagaagaaggaatccatcatcaaagttttataaaattgtaatataatacaaacttgtttgcttccttgtctctccctctgtctctctcatctctcctatcttctccatatatacttcatcttcacacccaaaactccacacaaaatatctctccctctatctgcaaattttccaaagttgcatcctttcaatttccactcctctctaatataattcacattttcccactattgctgattcatttttttttgtgaattatttcaaacccacataaaaaaatctttgtttaaatttaaaacca

SEQ ID NO: 73 - DNA, 998 bp, Arabidopsis thaliana
  misc_feature (1)..(998): Ceres Promoter YP0385
actcaacaataggacaagccaaaaaaattccaattattgtgttactctattcttctaaatttgaacactaatagactatgacatatgagtatataatgtgaagtcttaagatattttcatgtgggagatgaataggccaagttggagtctgcaaacaagaagctcttgagccacgacataagccaagttgatgaccgtaattaatgaaactaaatgtgtgtggttatatattagggacccatggccatatacacaatttttgtttctgtcgatagcatgcgtttatatatatttctaaaaaaactaacatatttactggatttgagttcgaatattgacactaatataaactacgtaccaaactacatatgtttatctatatttgattgatcgaagaattctgaactgttttagaaaatttcaatacacttaacttcatcttacaacggtaaaagaaatcaccactagacaaacaatgcctcataatgtctcgaaccctcaaactcaagagtatacattttactagattagagaatttgatatcctcaagttgccaaagaattggaagcttttgttaccaaacttagaaacagaagaagccacaaaaaaagacaaagggagttaaagattgaagtgatgcatttgtctaagtgtgaaaggtctcaagtctcaactttgaaccataataacattactcacactccctttttttttctttttttttcccaaagtaccctttttaattccctctataacccactcactccattccctctttctgtcactgattcaacacgtggccacactgatgggatccacctttcctcttacccacctcccggtttatataaacccttcacaacacttcatcgctctcaaaccaactctctcttctctcttctctcctctcttctacaagaagaaaaaaaacagagcctttacacatctcaaaatcgaacttactttaaccaccaaatactgattgaacacacttgaaa

SEQ ID NO: 74 - DNA, 1000 bp, Arabidopsis thaliana
  misc_feature (1)..(1000): Ceres Promoter YP0396
catagtaaaagtgaatttaatcatactaagtaaaataagataaaacatgttatttgaatttgaatatcgtgggatgcgtatttcggtatttgattaaaggtctggaaaccggagctcctataacccgaataaaaatgcataacatgttcttccccaacgaggcgagcgggtcagggcactagggtcattgcaggcagctcataaagtcatgatcatctaggagatcaaattgtatgtcggccttctcaaaattacctctaagaatctcaaacccaatcatagaacctctaaaaagacaaagtcgtcgctttagaatgggttcggtttttggaaccatatttcacgtcaatttaatgtttagtataatttctgaacaacagaattttggatttatttgcacgtatacaaatatctaattaataaggacgactcgtgactatccttacattaagtttcactgtcgaaataacatagtacaatacttgtcgttaatttccacgtctcaagtctataccgtcatttacggagaaagaacatctctgtttttcatccaaactactattctcactttgtctatatatttaaaattaagtaaaaaagactcaatagtccaataaaatgatgaccaaatgagaagatggttttgtgccagattttaggaaaagtgagtcaaggtttcacatctcaaatttgactgcataatcttcgccattaacaacggcattatatatgtcaagccaattttccatgttgcgtacttttctattgaggtgaaaatatgggtttgttgattaatcaaagagtttgcctaactaatataactacgactttttcagtgaccattccatgtaaactctgcttagtgtttcatttgtcaacaatattgtcgttactcattaaatcaaggaaaaatatacaattgtataattttcttatattttaaaattaattttgatgtattacccctttataaataggctatcgctacaacaccaataac

SEQ ID NO: 75 - DNA, 1514 bp, Arabidopsis thaliana
  misc_feature (1)..(1514): Ceres Promoter p13879
tttcgatcctcttcttttttaggtttcttgatttgatgatcgccgccagtagagccgtcgtcggaagtttcagagattaaaaccatcaccgtgtgagttggtagcgaattaacggaaagtctaagtcaagattttttaaaaagaaatttatgtgtgaaaagaagccgttgtgtatatttatataatttagaaaatgtttcatcattttaattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactactctcactgtaatcccttagatcttcttttcaaatttcaccattgcactggatg

SEQ ID NO: 76 - DNA, 1954 bp, Arabidopsis thaliana
  misc_feature (1)..(1954): Ceres Promoter p326
gtgggtaaaagtatccttctttgtgcatttggtatttttaagcatgtaataagaaaaaccaaaatagacggctggtatttaataaaaggagactaatgtatgtatagtatatgatttgtgtggaatataataaagttgtaaaatatagatgtgaagcgagtatctatcttttgactttcaaaggtgatcgatcgtgttctttgtgatagttttggtcgtcggtctacaagtcaacaaccaccttgaagttttcgcgtctcggtttcctcttcgcatctggtatccaatagcatacatataccagtgcggaaaatggcgaagactagtgggcttgaaccataaggtttggccccaatacggattccaaacaacaagcctagcgcagtcttttgggatgcataagactaaactgtcgcagtgatagacgtaagatatatcgacttgattggaatcgtctaagctaataagtttaccttgaccgtttatagttgcgtcaacgtccttatggagattgatgcccatcaaataaacctgaaaatccatcaccatgaccaccataaactcccttgctgccgctgctttggcttgagcaaggtgtttccttgtaaagctccgatctttggataaagtgttccactttttgcaagtagctctgacccctctcagagatgtcaccggaatcttagacagaacctcctctgccaaatcacttggaagatcggacaatgtcatcatttttgcaggtaatttctccttcgttgctgctttggcttgagcacggtgcttctttgtaaagctccgatctttggataagagcggatcggaatcctctaggaggtgccagtcccttgacctattaatttatagaaggttttagtgtattttgttccaatttcttctctaacttaacaaataacaactgcctcatagtcatgggcttcaaattttatcgcttggtgtatttcgttatttgcaaggccttggcccattttgagcccaataactaaatctagccttttcagaccggacatgaacttcgcatattggcgtaactgtgcagttttacctttttcggatcagacaagatcagatttagaccacccaacaatagtcagtcatatttgacaacctaagctagccgacactactaaaaagcaaacaaaagaagaattctatgttgtcattttaccggtggcaagtggacccttctataaaagagtaaagagacagcctgtgtgtgtataatctctaattatgttcaccgacacaatcacacaaacccttctctaatcacacaacttcttcatgatttacgacattaattatcattaactctttaaattcactttacatgctcaaaaatatctaatttgcagcattaatttgagtaccgataactattattataatcgtcgtgattcgcaatcttcttcattagatgctgtcaagttgtactcgcacgcggtggtccagtgaagcaaatccaacggtttaaaaccttcttacatttctagatctaatctgaaccgtcagatatctagatctcattgtctgaacacagttagatgaaactgggaatgaatctggacgaaattacgatcttacaccaaccccctcgacgagctcgtatatataaagcttatacgctcctccttcaccttcgtactactactaccaccacatttctttagctcaaccttcattactaatctccttttaaggtatgttcacttttcttcgattcatactttctcaagattcctgcatttctgtagaatttgaaccaagtgtcgatttttgtttgagagaagtgttgatttatagatctggttattgaatctagattccaatttttaattgattcgagtttgttatgtgtgtttatactacttctcattgatcttgtttgatttctctgctctgtattaggtttctttcgtgaatcagatcggaa

SEQ ID NO: 77 - DNA, 2016 bp, Arabidopsis thaliana
  misc_feature (1)..(2016): Ceres Promoter p32449
gatcggccttcttcaggtcttctctgtagctctgttacttctatcacagttatcgggtatttgagaaaaaagagttagctaaaatgaatttctccatataatcatggtttactacaggtttacttgattcgcgttagctttatctgcatccaaagttttttccatgatgttatgtcatatgtgataccgttactatgtttataactttatacagtctggttcactggagtttctgtgattatgttgagtacatactcattcatcctttggtaactctcaagtttaggttgtttgaattgcctctgttgtgatacttattgtctattgcatcaatcttctaatgcaccaccctagactatttgaacaaagagctgtttcattcttaaacctctgtgtctccttgctaaatggtcatgctttaatgtcttcacctgtctttctcttctatagatatgtagtcttgctagatagttagttctacagctctcttttgtagtcttgttagagagttagttgagatattacctcttaaaagtatccttgaacgctttccggttatgaccaatttgttgtagctccttgtaagtagaacttactgggaccagcgagacagtttatgtgaatgttcatgcttaagtgtcgaacgtatctatctctactatagctctgtagtcttgttagacagttagttttatatctccatttttttgtagtcttgctagttgagatattacctcttctcttcaaagtatccttgaacgctcaccggttatgaaatctctacactatagctctgtagtcttgctagatagttagttctttagctctctttttgtagcctagttctttagctctccttttgtagccttgctacagagtaagatgggatattacctccttgaacgctctccggttatgaccaatttgttgtagctccttgtaagtagaacttaggatagagtgagtcaactttaagaaagaacctagtatgtggcataaccagattgcaggctctgtctcggctacagtaacgtaactctatagctctttgttttgttcagaaagaaccagtgattggatgattcgtccttagaaactggacctaacaacagtcattggctttgaaatcaagccacaacaatgcctatatgaaccgtccatttcatttatccgtttcaaaccagcccattacatttcgtcccattgataaccaaaagcggttcaatcagattatgttttaattttaccaaattctttatgaagtttaaattatactcacattaaaaggattattggataatgtaaaaattctgaacaattactgattttggaaaattaacaaatattctttgaaatagaagaaaaagcctttttccttttgacaacaacatataaaatcatactcccattaaaaagattttaatgtaaaattctgaatataagatattttttacaacaacaaccaaaaatatttatttttttccttttttacagcaacaagaaggaaaaacttttttttttgtcaagaaaaggggagattatgtaaacagataaaacagggaaaataactaaccgaactctcttaattaacatcttcaaataaggaaaattatgatccgcatatttaggaagatcaatgcattaaaacaacttgcacgtggaaagagagactatacgctccacacaagttgcactaatggtacctctcacaaaccaatcaaaatactgaataatgccaacgtgtacaaattagggttttacctcacaaccatcgaacattctcgaaacattttaaacagcctggcgccatagatctaaactctcatcgaccaatttttgaccgtccgatggaaactctagcctcaacccaaaactctatataaagaaatcttttccttcgttattgcttaccaaatacaaaccctagccgccttattcgtcttcttcgttctctagttttttcctcagtctctgttcttagatcccttgtagtttccaaatcttccgataaggcct

SEQ ID NO: 78 - DNA, 1024 bp, Arabidopsis thaliana
  misc_feature (1)..(1024): Ceres Promoter PR0924
atctataacgagttaacatgttgccagtttgaatcaagaagcttggatgatgaatgaatggatcggtttgtggtacaattcttaaaattgtagtagaggagacagagaaaaaacatgataagactttggtatttacaacttgacggagacaagacagtaagccaaatctgtcacaaaaacactcaaactcttttctcagtgttttgagtttaaagagagacttattcacttcccctttcgtaacacttatttgtctcccaaccaaacagtttctgtcctttcccttgtcctcccacgtgcatctttatatctcatgacttttcgtttctagatcttgaataatgtcttagtggattaggtttgttgtcggtaaattaggtgaccgtttttttcttatatttggaagatcgcgggatgaagcagatactgagtttcagggcatacacacctaatttgaaaatcattgttagtccaatttcactttaatcttgtttacaaaaaaattgatctgaaaatgttgatgggataagtaaaaatgtaagttttgctagtagtcatgatataataatagcaaaaccagatcaattttgagcaaaaggaagaaacaaaaaacagatcgatcccacgagcaagactaagtgtaaagtggttcccacaagagccatatggatatggtccttcaacttttaaagcccattacttcagtggtcgacccgacattacgccacgagtagtcacgcacgcacgactccgttcacgtgacattcacgttgatatttccccctctactctcttctgcttggttgatctaaaaaacatgaagagaccaacctaatttcatattaatatatgatatagacttcatactcaacagtcactttcgtaatccaaatccatatcttacgaaattagttcttaataaaggttgtggattaagttataatattgtgttaagagttaagacacagcatataaccttgtaccaacagtgctttattcttaaatggaaacaaaacatatgtca

SEQ ID NO: 79 - DNA, 857 bp, Arabidopsis thaliana
  misc_feature (1)..(857): Ceres Promoter PD1367
  misc_feature (116)..(116): n is a, c, t, g, unknown, or other
  misc_feature (136)..(136): n is a, c, t, g, unknown, or other
  misc_feature (154)..(154): n is a, c, t, g, unknown, or other
  misc_feature (159)..(159): n is a, c, t, g, unknown, or other
  misc_feature (168)..(168): n is a, c, t, g, unknown, or other
  misc_feature (172)..(172): n is a, c, t, g, unknown, or other
  misc_feature (175)..(175): n is a, c, t, g, unknown, or other
  misc_feature (679)..(679): n is a, c, t, g, unknown, or other
  misc_feature (680)..(680): n is a, c, t, g, unknown, or other
  misc_feature (686)..(686): n is a, c, t, g, unknown, or other
  misc_feature (724)..(724): n is a, c, t, g, unknown, or other
  misc_feature (737)..(737): n is a, c, t, g, unknown, or other
ttggaattaattctgcggccatggggctgcaggaattcgatggcccgatcggccacagttttcttttctcatcttacaacaagtttccaggaggatagagacataaacgaagctcnggattgtatcgttctttttnagcttttattcacatccngaaangtcctgtangttntangattctgttatcttgcggttttgagttaatcagaaacagagtaatcaatgtaatgttgcaggctagatctttcatctttggaaatttgtttttttctcatgcaatttctttagcttgaccatgagtgactaaaagatcaatcagtagcaatgatttgatttggctaagagacatttgtccacttggcatcttgatttggatggttacaacttgcaagacccaattggatacttgctatgacaactccaactcaagagtgtcgtgtaactaagaaccttgactaatttgtaatttcaatcccaagtcatgttactatatgtttttttgtttgtattattttctctcctacaattaagctctttgacgtacgtaatctccggaaccaactcctatatccaccatttactccacgttgtctccaattattggacgttgaaacttgacacaacgtaaacgtatctacgtggttgattgtatgtacatatgtacaaacgtacacctttnnctcctnctttcacttcatcacttggcttgtgaattcattaattncctgcgaaggccntgcagggccatcaccactgcagtggaacaatgaagactaatctttttctctttctcatcttttcacttctcctatcattatcctcggccgaattcagtaaaggagaagaacttttcactg

SEQ ID NO: 80 - DNA, 1181 bp, Arabidopsis thaliana
  misc_feature (1)..(1181): Ceres CLONE ID no. 41573
  misc_feature (1)..(1181): Ceres SEED LINE: ME01720
  misc_feature: Encodes the peptide sequence given in SEQ ID no. 81
gacgatgacgatgatgatgatgatgatgaagttgatggagatgataatgagaaggagaaaattgggttatacgagctcaagaagggaaatctaactgtcaaattcacaaattggggtgcttcaatcatatctctccatttcccagacaaaaatggtaaaatggacgatattgttcttggctatgatagcgtcaaaacctacaagaccgacaaggtttatttcggagcaaccgttggccgagtagcaaatagaataggaaagggcaaattcaagttgaatggtaaagagtacaagacaagtgtcaacgatggaaaaaacacactccatggtggcaagaaagggtttggggatgttgtgtgggcagttgcaaaacaccagtacgatggcaagaaaccacacattgtcttcactcacacaagtcctgacggcgatcaagggtttccgggagaactcagtgtcacggtgacatataaacttgtcaaagacaatgaattgagtgtggtgatggaggcaaagcctaaggataaagcaactccggtgaacttagctcatcatagttattggaatcttggtggtcataattccggagatattttgtctgaagaaattcaaatcctcggctcgggttatacccccgtcgacggtgagctcattcccaccgggaaaatcaatccggtgaaaggaacagcatacgattttctccaactccgtcctattaaagataatatgaaggatcttaaaacaggatatgatataaattattgcttagatggtaaggcaaaaaagatgagaaaaatagttgaactcgtagataagaaatcagggaggaaaatggagttatccggaaaccaagcgggtttgcaattctataccggagggatgttaaaggatgtcaaagggaagaatggggcagtttaccaagctttcgggggattatgtttagaaacacaaagttatccagacgcattgaaccatcccaaatttccttcacagattgtcgagccagggaaaaaatacaaacacactatgctcttcaagttttctattgtttcatagattgttttagatgttgttacatgaacacccttggaaccatgtccaatgttcatgaacaagaaactaaatacattgtaatattttgtaacaatgcttaaattatcaaattatataaacctaacgtg

SEQ ID NO: 81 - protein, 298 aa, Arabidopsis thaliana
  misc_feature (1)..(298): Ceres CLONE ID no. 41573
  misc_feature (2)..(293): Pfam Name: Aldose_epim Pfam Description: Aldose 1-epimerase
  misc_feature (1)..(298): Ceres SEED LINE: ME01720
MDDIVLGYDSVKTYKTDKVYFGATVGRVANRIGKGKFKLNGKEYKTSVNDGKNTLHGGKKGFGDVVWAVAKHQYDGKKPHIVFTHTSPDGDQGFPGELSVTVTYKLVKDNELSVVMEAKPKDKATPVNLAHHSYWNLGGHNSGDILSEEIQILGSGYTPVDGELIPTGKINPVKGTAYDFLQLRPIKDNMKDLKTGYDINYCLDGKAKKMRKIVELVDKKSGRKMELSGNQAGLQFYTGGMLKDVKGKNGAAYQAFGGLCLETQSYPDALNHPKFPSQIVEPGKKYKHTMLFKFSIVS

SEQ ID NO: 82 - protein, 364 aa, Zea mays
  misc_feature (1)..(364): Ceres CLONE ID no. 1560908
  misc_feature (32)..(361): Pfam Name: Aldose_epim Pfam Description: Aldose 1-epimerase
  misc_feature (1)..(364): Functional Homolog of  Ceres CLONE ID no. 41573 at SEQ ID NO. 81 with e-value of 2.49E-82 and BLAST sequence identity of 54.9
MARAPLLLALLCACAAAAGSANAAAGRKMVGVYELKAGDFSVGVTNWGATITSVVLPDSKGDFADVVLGYDTIGGYVSGKSYFGALVGRVANRIANARFVLDGKAYHLFKNDGNNTLHGGHRGFSQVVWTVKEFVGGGDSPYITLYYHSFDGEQGFPGDLDVYVTYQLAAPYVLRVHMNATAVNKATPVNLAQHTYWNLGGQGSGDVLRNTVQLFASRYTPVGGGLIPTGAVAPVAGTPYDFLAPAAVGSRIRQVSGGKAGVYGYDTNYAVDGEPGALRKVAVVRDGASGRALELWANQPGVQFYTGNFLQDVKGKGGKVYQQYGALCLETQGFPDAVNHPDFPSQIVRPGQVYKHDMVFKFSF

SEQ ID NO: 83 - protein, 356 aa, Nicotiana tabacum
  misc_feature (1)..(356): Public GI no. 2739168
  misc_feature (29)..(351): Pfam Name: Aldose_epim Pfam Description: Aldose 1-epimerase
  misc_feature (1)..(356): Functional Homolog of  Ceres CLONE ID no. 41573 at SEQ ID NO. 81 with e-value of 8.99E-85 and BLAST sequence identity of 54.6
MSLKINLLVCLFIFHLLVAASVRGHKIGIYEIKKGDFSVKITNYGTSIISVLLPDKHGKIGDVVLGYDTIEEYKNDTSYFGATLGRVANRIGGAQFTLNGIHYKLVPNEGKNMLHGGPKGFSKVVWKVSKYVKDGPCPYITLTYYSADGEEGFPGAVLASVTYTLKDSYKLSVVFRAKALNKATPINLSHHPYWNIGGHDSGDVLSQVLQIFGSHITLVDKQLIPTGEIAPIKNTPYDFLKPRKVGSRINKLKNGYDINYVLDSTEKMKPVGIVYDKKSGRVMDVQASSPGVQFYTANFVNNTKGKGGFVYQPHSALSLETLVFPDAVNHPNFPSTIVNPGEKYVHSVLYTFSIKK

SEQ ID NO: 84 - protein, 336 aa, Zea mays
  misc_feature (1)..(336): Ceres CLONE ID no. 399052
  misc_feature (4)..(333): Pfam Name: Aldose_epim Pfam Description: Aldose 1-epimerase
  misc_feature (1)..(336): Functional Homolog of  Ceres CLONE ID no. 41573 at SEQ ID NO. 81 with e-value of 1.19E-82 and BLAST sequence identity of 54.5
MVGVYELKAGDFSVGVTNWGATITSVVLPDSKGDLSDVVLGYDTIGGYVSGKSYFGALVGRVANRIANARFVLDGKAYHLFKNDGNNTLHGGHRGFSQVVWTVKEFVGGGDSPYITLYYHSFDGEQGFPGDLDVYVTYQLAAPYVLRVHMNATAVNKATPVNLAQHTYWNLGGQGSGDVLRNTVQLFASRYTPVGGGLIPTGAVAPVAGTPYDFLAPAAVGSRIRQVSGGKAGVYGYDTNYAVDGEPGALRKVAVVRDGASGRALELWANQPGVQFYTGNFLQDVKGKGGKVYQQYGALCLETQGFPDAVNHPNFPSQIVRPGQVYKHDMVFKFSF

SEQ ID NO: 85 - protein, 368 aa, Triticum aestivum
  misc_feature (1)..(368): Ceres CLONE ID no. 1314177
  misc_feature (32)..(365): Pfam Name: Aldose_epim Pfam Description: Aldose 1-epimerase
  misc_feature (1)..(368): Functional Homolog of  Ceres CLONE ID no. 41573 at SEQ ID NO. 81 with e-value of 1.49E-82 and BLAST sequence identity of 54.2
MAGAPLLLLLAAVCLACFAPGANAAGRKMVGVYELSKGDFSAKVTNWGATVTSVVFPDSKGNLGDVVLGYDTIGEYVNGSSYFGALVGRVANRVAKARFVLDGKVYHLYANDGKNALHGGHRGFSKVIWTVKEYVSGGDSPHITLYYHSFDGEQGFPGALDVYVTYELSSPYVLSVRMNATALDKATPVNLAQHTYWNLGGEGSGDVLGNTVQLFAARYTPVDATLIPTGQLAPVAGTPYDLRAPTAVREHLRQVVGGSSNGSTIYGYDINYVVDGDARALRKVAAVRDGASGRALELWADQPGVQFYTGNFLQDVKGKGGSVYGQYGALCLETQGFPDAVNHPEFPSQIVRPGQAAYKHDMVFKFSF

SEQ ID NO: 86 - protein, 357 aa, Nicotiana tabacum
  misc_feature (1)..(357): Public GI no. 15824567
  misc_feature (30)..(352): Pfam Name: Aldose_epim Pfam Description: Aldose 1-epimerase
  misc_feature (1)..(357): Functional Homolog of  Ceres CLONE ID no. 41573 at SEQ ID NO. 81 with e-value of 2.09E-85 and BLAST sequence identity of 53.9
MSSKISLLLICLFILHLCAAASVRGRKIGIYEIKKGDFSVKITNYGATIISVLLPDKHGKIGDVVLGYDTIKEYKNDTSYFGAALGRVANRIGGAQFTLNGTHYKLVANEGVNMLHGGLKGFSKVVWKVSKYVRHGPSPYITLTYYSADGEEGFPGDVLVSVTYALKDPYKLSVVFKARALNKATPINLSHHPYWNIGGHNSGDVLSQVLQIYASHITPLDKQHIPTGEISPVKNTPYDFLKPRKVGSRIDKIQNGYDINYALDSSRKMKPVAIVFDKKSGRVMDIKATAPGVQFYTANFVINTKGKGGYVYQPHSALCLETQGFPDAVNHPNFPSTIVIPGKTYLHSVLYTFSIKK

SEQ ID NO: 87 - protein, 363 aa, Glycine max
  misc_feature (1)..(363): Ceres CLONE ID no. 1371577
  misc_feature (35)..(360): Pfam Name: Aldose_epim Pfam Description: Aldose 1-epimerase
  misc_feature (1)..(363): Functional Homolog of  Ceres CLONE ID no. 41573 at SEQ ID NO. 81 with e-value of 2.90E-79 and BLAST sequence identity of 53.2
MARALLVALLLVSCFVALGLSGRADAAAERKTVGVYELNKGDFSIKVTNWGATLMSVILLDSRGNFGDVILGYDTVAEYMNGTAYFGGLIGRVANRIANARFTLDGKTYRLVPNDGNNTLHGGHRGFDKVVWTVKEHVAGGSSPFITLYYHSFDGEQGFPGDVDVHVTYQLSSPHVLSVRMNATARGKATPVNLAHHAYWNLGGDGSGNVLGEEVRLFASRYTPVDASLIPTGRMASVAGTPYDFRTPAAVGSRIGGLLSRGVNGYDINYVVDGRGLRPVAVVRDGASGRAMELWADQPGVQFYTANGLSGVRGKGGKVYGHYGALCLETQGFPDAVNRPSFPSQIVRPGKVYKHDMVFKFSF

SEQ ID NO: 88 - protein, 357 aa, Nicotiana tabacum
  misc_feature (1)..(357): Public GI no. 15824565
  misc_feature (29)..(351): Pfam Name: Aldose_epim Pfam Description: Aldose 1-epimerase
  misc_feature (1)..(357): Functional Homolog of  Ceres CLONE ID no. 41573 at SEQ ID NO. 81 with e-value of 1.90E-84 and BLAST sequence identity of 53.2
MSSKINLLICLFILHLCAAASVRGRKIGIYEIKKGDFSVKITNYGASIISVFLPDKHGKIGDVVLGYDTIKEYKNDTSYFGAALGRVANRIGGAQFTLNGTHYKLVANEGVNMLHGGLKGFSKVVWKVSKYVRHGPSPYITLTYYSADGEEGFPGDVLVSVTYALKDPYKLSVVFKARALNKATPINLSHHPYWNIGGHNTGDVLSQVLQIYASHITPLDNQHIPTGEISPVKNTPYDFLKPHKVGSRINKIQNGYDINYALDSSKKMKPVAIVYDKKSGRVMDIKATAPGVQFYTANFVINTKGKGGYVYQPHSALCLETQGFPDAVNHPNFPSTIVTPGKTNVHSVLYTFSIKKY

SEQ ID NO: 89 - protein, 376 aa, Oryza sativa subsp. japonica
  misc_feature (1)..(376): Public GI no. 50920801
  misc_feature (43)..(370): Pfam Name: Aldose_epim Pfam Description: Aldose 1-epimerase
  misc_feature (1)..(376): Functional Homolog of  Ceres CLONE ID no. 41573 at SEQ ID NO. 81 with e-value of 1.80E-77 and BLAST sequence identity of 53.2
MAATSARSVAWQWLAVAAAVAAASLIGGTPAEARRGGKESIGFYELRRGEFSVVVTNWGATILTVNLPDKNGHIDDVVLGYKDIGSYVNDTTYFGALVGRVANRIAGGRFTVKGHAFHTYKNDGKNTLHGGHRGFNQVFWSVRERATGHFPYITFYYRSYDGEQGFPGALDVLVTYKIDGDYSFSVTMYARPVDDGKPTPVNLAQHTYWNLRGHGNGTILDHSVQIFASAVTPVGAGLIPTGAVSPVSGTPFDFRAPAPPGARIADVPGGGYDINYVLDGEADGQGVRKAAVVSEPTSGRVLELWSDQPGLQFYTGNFLKGDEGKGGARYVKHGGLCLETQDYPDAVHNAKFPTEIYRKGQEYKHYMLYKFSLAKK

SEQ ID NO: 90 - protein, 378 aa, Oryza sativa subsp. japonica
  misc_feature (1)..(378): Public GI no. 50909807
  misc_feature (38)..(375): Pfam Name: Aldose_epim Pfam Description: Aldose 1-epimerase
  misc_feature (1)..(378): Functional Homolog of  Ceres CLONE ID no. 41573 at SEQ ID NO. 81 with e-value of 7.20E-76 and BLAST sequence identity of 51.8
MARAVLTLTVLAFLCLVALGLSGRANANATAGRKMVGVYELKKGDFSIRVTNWGATIMSVILPDSKGNLADVVLGYDTVAEYVNGTAYFGGLIGRVANRIANARFTLDGKTYRLFRNDGNNSLHGGHRGFSKVIWTVKEHVAGGDSPRITLYYHSFDGEQGFPGDLDVFVTYELPRPYVLAVRMNATARGKATPVNLAHHAYWNLAGEGSGAASVLAETVRIHASRYTPVDAATLIPTGRVAPVAGTPYDFLAGAPVGARIVGAAVPGGAVSGYDTNYAVDGAAADGERRRLRPVAEVRDGATGRAMEVWADQPGVQFYTSNGLAGVRGKGGRVYGRYGALCLETQGFPDAVNHPSFPSQIVRPGQVYEHNMVFKFTF

SEQ ID NO: 91 - protein, 359 aa, Triticum aestivum
  misc_feature (1)..(359): Ceres CLONE ID no. 639223
  misc_feature (30)..(356): Pfam Name: Aldose_epim Pfam Description: Aldose 1-epimerase
  misc_feature (1)..(359): Functional Homolog of  Ceres CLONE ID no. 41573 at SEQ ID NO. 81 with e-value of 1.20E-75 and BLAST sequence identity of 51.2
MARAPVFPALLCLAVLALAGGADARKMVGVYELKRGDFSVKMTNWGATIMSILVPDSKGNLADVVLGMDTLAEYVNDTSYFGPLNGRVAQRMARGRFVLDGKVYHTYINDGKNAIHGGKRGFSKVIWTVKEYVAGGDSPYITMYYRSFDGEQGFPGDLDVYATYQLTGPYELSIRTNATALNKATPVNFLQHVYLNLGGEGSGDILGHTLQLSASRYTPLDVEMLPSSGRVDPVAGTSYDFRTPTPIGARIRQVMGGKVYGYDINYVIDGEGMRKVAAVRDGKSGRALELWANQPAMQLYTGNFLNHTKGKGGKLYEQYGGFCLETQAYPDAVNHPEFPSVTVRPGQVYKHDMRFTFSF

SEQ ID NO: 92 - protein, 343 aa, Oryza sativa
  misc_feature (1)..(343): Public GI no. 37531218
  misc_feature (6)..(340): Pfam Name: Aldose_epim Pfam Description: Aldose 1-epimerase
  misc_feature (1)..(343): Functional Homolog of  Ceres CLONE ID no. 41573 at SEQ ID NO. 81 with e-value of 1.80E-72 and BLAST sequence identity of 51.2
MAAEEILELSNGRITAKIAAWGATITSLIVPDAHGNLADVVLGFDTLEPYMEYVGTGKGGQKGISPYFGCIVGRVANRIKEGKFTLNGVEYSLAINNGPNSLHGGLKGFDKVVWDVVERKSECPSITFQYHSKDGEEGYPGDVTVRATYSLPDSTTLRLDMEAVAENKATPINLAQHTYWNLAGHNSGDTLDHSIQIWGKHITPVDENTIPTGEIMPVKGTPFDFTTEHKIGARINDVPGGYDHNYVLDSGEEKNGLKHAAKLKDSSNSRTLDLWTDAPGMQFYTANYVDGVTGKGGAVYGKHSGVCLETQGFPNAINQPNFPSVVVQPGEKYKHTMLFEFSA

SEQ ID NO: 93 - DNA, 562 bp, Arabidopsis thaliana
  misc_feature (1)..(562): Ceres CLONE ID no. 25429
  misc_feature (1)..(562): Ceres SEED LINE: ME01597
  misc_feature: Encodes the peptide sequence given in SEQ ID no. 94
atttcattttcgttttcactttctccgaacatccaaaagcttgtagcttgctcctcaaatcttcttgaaaaatgaaggttgccgctgctttcctcctcgccgttttgggcggaaacgctaatccttcagccgagaatatcaaagatatcatcggagctgttggtgctgatgttgatggagagagcattgagcttctattgaaagaagtgagtggtaaggacattgctgagctgattgcttctggtagggagaaattagcgtctgtgccatctggtggtggtgtggctgtttcagctgctccatcaagcggtggtggtggtgctgctgctgctgcccctgcggagaagaaagaagccaagaaggaagagaaagaagagtctgatgatgacatgggattcagtctcttcgagtaaggtttttgtccccacggaaaggagtcgagatttgattttttgttctcttagtggttctggtttttgctcctctttgtagttcggtgttattaaagattcttggattacgaattttactcgttagataatgaagcaagaagagttttttc

SEQ ID NO: 94 - protein, 113 aa, Arabidopsis thaliana
  misc_feature (1)..(113): Ceres CLONE ID no. 25429
  misc_feature (17)..(112): Pfam Name: Ribosomal_60s Pfam Description: 60s Acidic ribosomal protein
  misc_feature (1)..(113): Ceres SEED LINE: ME01597
MKVAAAFLLAVLGGNANPSAENIKDIIGAVGADVDGESIELLLKEVSGKDIAELIASGREKLASVPSGGGVAVSAAPSSGGGGAAAAAPAEKKEAKKEEKEESDDDMGFSLFE

SEQ ID NO: 95 - DNA, 345 bp, Populus balsamifera subsp. trichocarpa
  misc_feature (1)..(345): Ceres ANNOT ID no. 1488311
  misc_feature (1)..(345): Functional Homolog of  Ceres CLONE ID no. 25429 at SEQ ID NO. 94 with e-value of 1.70E-35 and BLAST sequence identity of 75.0
  misc_feature: Encodes the peptide sequence at SEQ ID No. 96
atgaaggttgtagccgcttacttgctcgccgttctcggtggcaacacctgccctaccgccgaggacttgaagcacatcctcggatctgttggagcagatgctgatgatgacaggattgagctgctgttgtccagtgtgaaaggaaaggacataactgagctgattgcttccggaagggagaagttggcttccgtcccttccggtggtggcgttgctgtcgctgccggtggagctccagctgctgcttccggtggtgctgcccctgctgccgaggcaaagaaagaggagaaggttgaagagaaagaggagtctgatgatgatatgggtttcagtctattcgattaa

SEQ ID NO: 96 - protein, 114 aa, Populus balsamifera subsp. trichocarpa
  misc_feature (1)..(114): Ceres ANNOT ID no. 1488311
  misc_feature (17)..(113): Pfam Name: Ribosomal_60s Pfam Description: 60s Acidic ribosomal protein
  misc_feature (1)..(114): Functional Homolog of  Ceres CLONE ID no. 25429 at SEQ ID NO. 94 with e-value of 1.70E-35 and BLAST sequence identity of 75.0
MKVVAAYLLAVLGGNTCPTAEDLKHILGSVGADADDDRIELLLSSVKGKDITELIASGREKLASVPSGGGVAVAAGGAPAAASGGAAPAAEAKKEEKVEEKEESDDDMGFSLFD

SEQ ID NO: 97 - protein, 113 aa, Brassica napus
  misc_feature (1)..(113): Ceres CLONE ID no. 953928
  misc_feature (17)..(112): Pfam Name: Ribosomal_60s Pfam Description: 60s Acidic ribosomal protein
  misc_feature (1)..(113): Functional Homolog of  Ceres CLONE ID no. 25429 at SEQ ID NO. 94 with e-value of 1.49E-34 and BLAST sequence identity of 74.7
MKVVAAFLLAVLSGKACPTSADIKVILNSVGCETEDSQIELLLKEVNGKDVAELIAVGREKLASVPSGGGGVAMASAPSAGGGGGAAPAEDKKEEKKEEKEESDDDMGFSLFE

SEQ ID NO: 98 - protein, 114 aa, Glycine max
  misc_feature (1)..(114): Ceres CLONE ID no. 524682
  misc_feature (17)..(113): Pfam Name: Ribosomal_60s Pfam Description: 60s Acidic ribosomal protein
  misc_feature (1)..(114): Functional Homolog of  Ceres CLONE ID no. 25429 at SEQ ID NO. 94 with e-value of 3.60E-33 and BLAST sequence identity of 74.5
MKVVAAYLLAVLGGNNSPSADVIKEILGSVGVEADEDRIESFLSEVKGKDIVELIAAGREKLATVPSGCGGAVAVAAAPGGGAAAAAPAAEAKKEEKVEEKEESDDDMGFSLFD

SEQ ID NO: 99 - protein, 100 aa, Parthenium argentatum
  misc_feature (1)..(100): Ceres CLONE ID no. 1609735
  misc_feature (17)..(96): Pfam Name: Ribosomal_60s Pfam Description: 60s Acidic ribosomal protein
  misc_feature (1)..(100): Functional Homolog of  Ceres CLONE ID no. 25429 at SEQ ID NO. 94 with e-value of 1.29E-28 and BLAST sequence identity of 73.4
MKVVAAYLLALLGGNTSPSAEDLKNILGSVGADCDDDKIELLLSEVKGKDITELIASGREKLASVPSGGGGVAVAAAAGGGGAAPAAAAAESKKEERSKR

SEQ ID NO: 100 - protein, 114 aa, Brassica napus
  misc_feature (1)..(114): Ceres CLONE ID no. 949174
  misc_feature (17)..(113): Pfam Name: Ribosomal_60s Pfam Description: 60s Acidic ribosomal protein
  misc_feature (1)..(114): Functional Homolog of  Ceres CLONE ID no. 25429 at SEQ ID NO. 94 with e-value of 2.40E-36 and BLAST sequence identity of 73.4
MKVVAAFLLAVLSGKASPTSADIKDILGSVGAETEDAQIELLLKEVKGKDCAELIALGREKLASVPCGGGGVAMASAPSAGGGGGAAPAEEAKKEEKKEEKEESDDDMGFSLFE

SEQ ID NO: 101 - protein, 114 aa, Brassica napus
  misc_feature (1)..(114): Ceres CLONE ID no. 1299820
  misc_feature (17)..(113): Pfam Name: Ribosomal_60s Pfam Description: 60s Acidic ribosomal protein
  misc_feature (1)..(114): Functional Homolog of  Ceres CLONE ID no. 25429 at SEQ ID NO. 94 with e-value of 3.90E-36 and BLAST sequence identity of 72.5
MKVVAAFLLAVLSGKASPTSADIKDILGSVGAETEDAQIEILLKEVKGKDCAELIAVGREKLASVPCGGGGVAMASAPSAGGGGGAAPAAEAKKEEKKEEKEESDDDMGFSLFE

SEQ ID NO: 102 - protein, 114 aa, Hyacinthus orientalis
  misc_feature (1)..(114): Public GI no. 42565379
  misc_feature (17)..(113): Pfam Name: Ribosomal_60s Pfam Description: 60s Acidic ribosomal protein
  misc_feature (1)..(114): Functional Homolog of  Ceres CLONE ID no. 25429 at SEQ ID NO. 94 with e-value of 1.30E-35 and BLAST sequence identity of 72.5
MKVVAAYLLAVLGGNTTPSAEVIKDILGSVGADAEDDRIELLLSEVKGKDITELIASGREKFASVPSGGAAIAVSAPAAGGGAAPAAAAAETKKEEKVEEKEESDEDMGFSLFD

SEQ ID NO: 103 - protein, 115 aa, Zea mays
  misc_feature (1)..(115): Ceres CLONE ID no. 426736
  misc_feature (17)..(114): Pfam Name: Ribosomal_60s Pfam Description: 60s Acidic ribosomal protein
  misc_feature (1)..(115): Functional Homolog of  Ceres CLONE ID no. 25429 at SEQ ID NO. 94 with e-value of 2.80E-35 and BLAST sequence identity of 71.6
MKVVAAYLLAVLSGKASPTSADIKTILGSVGAETEDSQIELLLKEVKGKDLAELIAAGREKLASVPSGGGGGVAVASATSGGGGGGGAPAAESKKEEKKEEKEESDDDMGFSLFE

SEQ ID NO: 104 - protein, 113 aa, Brassica napus
  misc_feature (1)..(113): Ceres CLONE ID no. 1094375
  misc_feature (17)..(112): Pfam Name: Ribosomal_60s Pfam Description: 60s Acidic ribosomal protein
  misc_feature (1)..(113): Functional Homolog of  Ceres CLONE ID no. 25429 at SEQ ID NO. 94 with e-value of 1.39E-33 and BLAST sequence identity of 71.4
  misc_feature (3)..(3): Xaa is any aa, unknown, or other
  misc_feature (4)..(4): Xaa is any aa, unknown, or other
  misc_feature (47)..(47): Xaa is any aa, unknown, or other
  misc_feature (56)..(56): Xaa is any aa, unknown, or other
MKXXAAFLLAVLSGKACPTSADIKVILNSVGCETEDSQIELLLKEVXGKDVAELIXVGREKLASVPSGGGGVAMASAPSAGGGGGAAPAEAKKEEKKEEKEESDDDMGFSLFE

SEQ ID NO: 105 - protein, 114 aa, Glycine max
  misc_feature (1)..(114): Ceres CLONE ID no. 691062
  misc_feature (17)..(112): Pfam Name: Ribosomal_60s Pfam Description: 60s Acidic ribosomal protein
  misc_feature (1)..(114): Functional Homolog of  Ceres CLONE ID no. 25429 at SEQ ID NO. 94 with e-value of 2.89E-33 and BLAST sequence identity of 71.1
MKVVAAYLLAVLGGNNSPSADVIKEILGSVGVEADEDRIESFLSEVKGKDIVELIAAGREKLASVPSGGGGAVAVAAAPGGGAAAAAPAAEAKKEEKVEEKEESDDDMGFSLSD

SEQ ID NO: 106 - protein, 114 aa, Hyacinthus orientalis
  misc_feature (1)..(114): Public GI no. 47026878
  misc_feature (17)..(113): Pfam Name: Ribosomal_60s Pfam Description: 60s Acidic ribosomal protein
  misc_feature (1)..(114): Functional Homolog of  Ceres CLONE ID no. 25429 at SEQ ID NO. 94 with e-value of 2.49E-34 and BLAST sequence identity of 70.7
MKVVAAYLLAVLGGNTTPSAEVIKDILGSVGAEAEDDRILLLLSEVKGKDITELIASGREKFASVPSGGAAIAVSAPAAGGGAAPAAAAAETKKEEKVEEKEESDEDMGFSLFD

SEQ ID NO: 107 - protein, 113 aa, Prunus dulcis
  misc_feature (1)..(113): Public GI no. 24473796
  misc_feature (17)..(112): Pfam Name: Ribosomal_60s Pfam Description: 60s Acidic ribosomal protein
  misc_feature (1)..(113): Functional Homolog of  Ceres CLONE ID no. 25429 at SEQ ID NO. 94 with e-value of 8.20E-36 and BLAST sequence identity of 69.9
MKVVAAYLLAVLGGNTTPSAEDLKDILGSVGAETDDDRIQLLLSEVKGKDITELIASGREKLASVPSGGGAVAVAAPGAGAGAAAPAAAEPKKEEKVEEKEDTDDDMGFSLFD

SEQ ID NO: 108 - DNA, 459 bp, Populus balsamifera subsp. trichocarpa
  misc_feature (1)..(459): Ceres ANNOT ID no. 1465437
  misc_feature (1)..(459): Functional Homolog of  Ceres CLONE ID no. 25429 at SEQ ID NO. 94 with e-value of 3.39E-30 and BLAST sequence identity of 67.2
  misc_feature: Encodes the peptide sequence at SEQ ID No. 109
atgatcgttgctgaatctctgttacatcgtcctgcaaagatctctcaaggaaaggagacaccgaggaagttcaaaaggacatggcttgtgcagatcatcgccagaggaaaaggaaagaaagaaacaatgaagactgttgctgctttcttgttggctgttttgggtggcaacaatagcccttctgctgaagatatcaagaagattcttgcctctgttggtgctgaagctgatgataagattgagctactcttgtctcaagttaaggataaggatataactgagcttattgctgctggaagggagaaattagcttctgtgccttgtggtggtggcgcagttgttgcagcggctgctccagctgatggcgctgctgctcctgctgctgctgagacaaaagaggagaaggtagaggagaaagaggatacagatgatgatctgggcttcagtctctttgattga

SEQ ID NO: 109 - protein, 110 aa, Populus balsamifera subsp. trichocarpa
  misc_feature (1)..(110): Ceres ANNOT ID no. 1465437
  misc_feature (17)..(109): Pfam Name: Ribosomal_60s Pfam Description: 60s Acidic ribosomal protein
  misc_feature (1)..(110): Functional Homolog of  Ceres CLONE ID no. 25429 at SEQ ID NO. 94 with e-value of 3.39E-30 and BLAST sequence identity of 67.2
MKTVAAFLLAVLGGNNSPSAEDIKKILASVGAEADDKIELLLSQVKDKDITELIAAGREKLASVPCGGGAVVAAAAPADGAAAPAAAETKEEKVEEKEDTDDDLGFSLFD

SEQ ID NO: 110 - DNA, 525 bp, Arabidopsis thaliana
  misc_feature (1)..(525): Ceres CLONE ID no. 5750
  misc_feature (1)..(525): Ceres SEED LINE: ME01833
  misc_feature: Encodes the peptide sequence given in SEQ ID no. 111
aaaaacgatcagattacagattcttcaattcctctttcccttctcctccatttcctgattaaggcttcacatctctgagagagaaatgggtcagatccaatactccgagaaatacttcgatgacactttcgaatacaggcacgtcgttcttcctcctgaagtcgctaaacttcttccaaagaatcgtcttctctccgaaaacgaatggcgagcgataggagtgcagcaaagccgcggatgggtacattacgcggttcatcgacctgagccgcacataatgctattcaggaggcctcttaactatcagcagcagcaggagaatcaagctcagaacatgcttgttaagtgaatcattatcatcacctgagtaagaatgttatatgcaacaattctatgagtattggtttatgtttcttgtaaacatggtttgaatctttgtggttatggatgaatatgtgagagttggtttgttgaacaacttctatgtaatgttagtcttggttctaatgtcatcttctgcttctt

SEQ ID NO: 111 - protein, 87 aa, Arabidopsis thaliana
  misc_feature (1)..(87): Ceres CLONE ID no. 5750
  misc_feature (1)..(72): Pfam Name: CKS Pfam Description: Cyclin-dependent kinase regulatory subunit
  misc_feature (1)..(87): Ceres SEED LINE: ME01833
MGQIQYSEKYFDDTFEYRHVVLPPEVAKLLPKNRLLSENEWRAIGVQQSRGWVHYAVHRPEPHIMLFRRPLNYQQQQENQAQNMLVK

SEQ ID NO: 112 - protein, 88 aa, Glycine max
  misc_feature (1)..(88): Public GI no. 42362268
  misc_feature (1)..(72): Pfam Name: CKS Pfam Description: Cyclin-dependent kinase regulatory subunit
  misc_feature (1)..(88): Functional Homolog of  Ceres CLONE ID no. 5750 at SEQ ID NO. 111 with e-value of 1.20E-41 and BLAST sequence identity of 96.5
MGQIQYSEKYFDDTYEYRHVVLPPEVAKLLPKNRLLSENEWRAIGVQQSRGWVHYAIHRPEPHIMLFRRPLNYQQQQENQAQQSMLVK

SEQ ID NO: 113 - protein, 88 aa, Glycine max; identical to SEQ ID NO: 112
  misc_feature (1)..(88): Ceres CLONE ID no. 709027
  misc_feature (1)..(72): Pfam Name: CKS Pfam Description: Cyclin-dependent kinase regulatory subunit
  misc_feature (1)..(88): Functional Homolog of  Ceres CLONE ID no. 5750 at SEQ ID NO. 111 with e-value of 1.20E-41 and BLAST sequence identity of 96.5

SEQ ID NO: 114 - protein, 88 aa, Glycine max; identical to SEQ ID NO: 112
  misc_feature (1)..(88): Ceres CLONE ID no. 853298
  misc_feature (1)..(72): Pfam Name: CKS Pfam Description: Cyclin-dependent kinase regulatory subunit
  misc_feature (1)..(88): Functional Homolog of  Ceres CLONE ID no. 5750 at SEQ ID NO. 111 with e-value of 1.20E-41 and BLAST sequence identity of 96.5

SEQ ID NO: 115 - protein, 88 aa, Glycine max; identical to SEQ ID NO: 112
  misc_feature (1)..(88): Ceres CLONE ID no. 1417425
  misc_feature (1)..(72): Pfam Name: CKS Pfam Description: Cyclin-dependent kinase regulatory subunit
  misc_feature (1)..(88): Functional Homolog of  Ceres CLONE ID no. 5750 at SEQ ID NO. 111 with e-value of 1.20E-41 and BLAST sequence identity of 96.5

SEQ ID NO: 116 - protein, 83 aa, Populus tremula x Populus tremuloides
  misc_feature (1)..(83): Public GI no. 27435806
  misc_feature (1)..(72): Pfam Name: CKS Pfam Description: Cyclin-dependent kinase regulatory subunit
  misc_feature (1)..(83): Functional Homolog of  Ceres CLONE ID no. 5750 at SEQ ID NO. 111 with e-value of 9.09E-37 and BLAST sequence identity of 94.8
MGQIQYSEKYLDDTFEYRHVVLPPEVAKLLIKNRLLSENEWRAIGVQQSRGWVHYAIHRPEPHIMLFRRPLNYQQQQDQALVK

SEQ ID NO: 117 - DNA, 252 bp, Populus balsamifera subsp. trichocarpa
  misc_feature (1)..(252): Ceres ANNOT ID no. 1481954
  misc_feature (1)..(252): Functional Homolog of  Ceres CLONE ID no. 5750 at SEQ ID NO. 111 with e-value of 9.09E-37 and BLAST sequence identity of 94.8
  misc_feature: Encodes the peptide sequence at SEQ ID No. 118
atgggtcagatccagtactccgagaagtatttagatgatacttttgagtacaggcatgtggtgcttcctcctgaagtcgctaaacttctcattaagaatcgccttctctctgaaaatgagtggcgagcgattggagttcagcagagccgagggtgggtccattatgcgattcatcgcccggagccacacatcatgctgttcaggaggcctttgaattatcagcagcagcaggatcaagctcttgtcaagtga

SEQ ID NO: 118 - protein, 83 aa, Populus balsamifera subsp. trichocarpa; identical to SEQ ID NO: 116
  misc_feature (1)..(83): Ceres ANNOT ID no. 1481954
  misc_feature (1)..(72): Pfam Name: CKS Pfam Description: Cyclin-dependent kinase regulatory subunit
  misc_feature (1)..(83): Functional Homolog of  Ceres CLONE ID no. 5750 at SEQ ID NO. 111 with e-value of 9.09E-37 and BLAST sequence identity of 94.8

SEQ ID NO: 119 - protein, 88 aa, Ipomoea trifida
  misc_feature (1)..(88): Public GI no. 45935118
  misc_feature (1)..(72): Pfam Name: CKS Pfam Description: Cyclin-dependent kinase regulatory subunit
  misc_feature (1)..(88): Functional Homolog of  Ceres CLONE ID no. 5750 at SEQ ID NO. 111 with e-value of 5.19E-41 and BLAST sequence identity of 94.2
MGQIQYSEKYFDDTFEYRHVVLPPEVAKLLPKNRLLSENEWRAIGVQQSRGWVHYAIHRPEPHIMLFRRPLNYQQQQESQAQLNLIAK

SEQ ID NO: 120 - protein, 90 aa, Triticum aestivum
  misc_feature (1)..(90): Ceres CLONE ID no. 1017141
  misc_feature (1)..(72): Pfam Name: CKS Pfam Description: Cyclin-dependent kinase regulatory subunit
  misc_feature (1)..(90): Functional Homolog of  Ceres CLONE ID no. 5750 at SEQ ID NO. 111 with e-value of 3.79E-38 and BLAST sequence identity of 93.8
MGQIQYSEKYFDDTFEYRHVVLPPEVAKLLPKNRLLAENEWRALGVQQSRGWVHYAVHRPEPHIMLFRRPLNYQQQQDAAAAAAAQMMPK

SEQ ID NO: 121 - protein, 90 aa, Zea mays; identical to SEQ ID NO: 120
  misc_feature (1)..(90): Ceres CLONE ID no. 1448636
  misc_feature (1)..(72): Pfam Name: CKS Pfam Description: Cyclin-dependent kinase regulatory subunit
  misc_feature (1)..(90): Functional Homolog of  Ceres CLONE ID no. 5750 at SEQ ID NO. 111 with e-value of 3.79E-38 and BLAST sequence identity of 93.8

SEQ ID NO: 122 - protein, 90 aa, Oryza sativa subsp. japonica
  misc_feature (1)..(90): Public GI no. 50919707
  misc_feature (1)..(72): Pfam Name: CKS Pfam Description: Cyclin-dependent kinase regulatory subunit
  misc_feature (1)..(90): Functional Homolog of  Ceres CLONE ID no. 5750 at SEQ ID NO. 111 with e-value of 3.79E-38 and BLAST sequence identity of 93.8
MGQIQYSEKYFDDTYEYRHVVLPPEVAKLLPKNRLLSENEWRAIGVQQSRGWVHYAIHRPEPHIMLFRRPLNFQQQQEAAAAAAAQMLPK

SEQ ID NO: 123 - protein, 90 aa, Triticum aestivum; identical to SEQ ID NO: 120
  misc_feature (1)..(90): Public GI no. 40641585
  misc_feature (1)..(72): Pfam Name: CKS Pfam Description: Cyclin-dependent kinase regulatory subunit
  misc_feature (1)..(90): Functional Homolog of  Ceres CLONE ID no. 5750 at SEQ ID NO. 111 with e-value of 3.79E-38 and BLAST sequence identity of 93.8

SEQ ID NO: 124 - protein, 83 aa, Arabidopsis thaliana
  misc_feature (1)..(83): Public GI no. 38566522
  misc_feature (1)..(72): Pfam Name: CKS Pfam Description: Cyclin-dependent kinase regulatory subunit
  misc_feature (1)..(83): Functional Homolog of  Ceres CLONE ID no. 5750 at SEQ ID NO. 111 with e-value of 4.39E-37 and BLAST sequence identity of 93.75
MGQIQYSDKYFDDTFEYRHVVLPPEVAKLLPKNRILSESEWRAIGVQQSRGWVHYAIHRPEPHIMLFRRPLNYQQEHQAQIAK

SEQ ID NO: 125 - protein, 83 aa, Arabidopsis thaliana; identical to SEQ ID NO: 124
  misc_feature (1)..(83): Ceres CLONE ID no. 1338131
  misc_feature (1)..(72): Pfam Name: CKS Pfam Description: Cyclin-dependent kinase regulatory subunit
  misc_feature (1)..(83): Functional Homolog of  Ceres CLONE ID no. 5750 at SEQ ID NO. 111 with e-value of 4.39E-37 and BLAST sequence identity of 93.75

SEQ ID NO: 126 - protein, 87 aa, Zea mays
  misc_feature (1)..(87): Ceres CLONE ID no. 300692
  misc_feature (1)..(72): Pfam Name: CKS Pfam Description: Cyclin-dependent kinase regulatory subunit
  misc_feature (1)..(87): Functional Homolog of  Ceres CLONE ID no. 5750 at SEQ ID NO. 111 with e-value of 9.79E-40 and BLAST sequence identity of 90.8
MGQIQYSEKYFDDTYEYRHVVLPPEVAKLLPKNRLLSENEWRAIGVQQSRGWVHYAIHRPEPHIMLFRRPINYQQQQEAAAAQMLAK

SEQ ID NO: 127 - protein, 88 aa, Brassica napus
  misc_feature (1)..(88): Ceres CLONE ID no. 947192
  misc_feature (1)..(72): Pfam Name: CKS Pfam Description: Cyclin-dependent kinase regulatory subunit
  misc_feature (1)..(88): Functional Homolog of  Ceres CLONE ID no. 5750 at SEQ ID NO. 111 with e-value of 3.30E-39 and BLAST sequence identity of 90.8
MGQIQYSDKYFDDTFEYRHVVLPPDTAKLLPKNRLLSENEWRAIGVQQSRGWVHYAIHRPEPHIMLFRRTLNYQQQQQENHAQNVLAK

SEQ ID NO: 128 - protein, 90 aa, Zea mays
  misc_feature (1)..(90): Ceres CLONE ID no. 1465004
  misc_feature (1)..(72): Pfam Name: CKS Pfam Description: Cyclin-dependent kinase regulatory subunit
  misc_feature (1)..(90): Functional Homolog of  Ceres CLONE ID no. 5750 at SEQ ID NO. 111 with e-value of 8.80E-39 and BLAST sequence identity of 90.8
MGQIQYSDKYFDDTFEYRHVVLPPDTAKLLPKNRLLSENEWRAIGVQQSRGWVHYAIHRPEPHIMLFRRTLNYQQPQQQQENHAQNVLAK

SEQ ID NO: 129 - protein, 90 aa, Brassica napus
  misc_feature (1)..(90): Ceres CLONE ID no. 1122958
  misc_feature (1)..(72): Pfam Name: CKS Pfam Description: Cyclin-dependent kinase regulatory subunit
  misc_feature (1)..(90): Functional Homolog of  Ceres CLONE ID no. 5750 at SEQ ID NO. 111 with e-value of 6.19E-38 and BLAST sequence identity of 89.6
  misc_feature (6)..(6): Xaa is any aa, unknown, or other
MGQIQXSDKYFDDTFEYRHVVLPPDTAKLLPKNRLLSENEWRAIGVQQSRGWVHYAIHRPEPHIMLFRRTLNYQQPQQQQENHAQNVLAK

SEQ ID NO: 130 - protein, 81 aa, Brassica napus
  misc_feature (1)..(81): Ceres CLONE ID no. 944737
  misc_feature (1)..(72): Pfam Name: CKS Pfam Description: Cyclin-dependent kinase regulatory subunit
  misc_feature (1)..(81): Functional Homolog of  Ceres CLONE ID no. 5750 at SEQ ID NO. 111 with e-value of 9.69E-33 and BLAST sequence identity of 86.4
MARIEYSDKYFDDTYEYRHVVLPPEVAKLLPKNRILAESEWRAIGVQQSRGWVHYAIHRPEPHIMLFRRTLNYQAPNPIPK

SEQ ID NO: 131 - protein, 88 aa, Zea mays
  misc_feature (1)..(88): Ceres CLONE ID no. 217797
  misc_feature (1)..(72): Pfam Name: CKS Pfam Description: Cyclin-dependent kinase regulatory subunit
  misc_feature (1)..(88): Functional Homolog of  Ceres CLONE ID no. 5750 at SEQ ID NO. 111 with e-value of 5.80E-35 and BLAST sequence identity of 85.1
MEQIQYSEKYFDDTYEYRHVVLPPEVAKLLPRNILLSEKQWRLVGVQQSRGWVHYAIHRPEPHIMLFRRPINYQQQQEEAAAAHVLPK

SEQ ID NO: 132 - protein, 88 aa, Glycine max; identical to SEQ ID NO: 131
  misc_feature (1)..(88): Ceres CLONE ID no. 520185
  misc_feature (1)..(72): Pfam Name: CKS Pfam Description: Cyclin-dependent kinase regulatory subunit
  misc_feature (1)..(88): Functional Homolog of  Ceres CLONE ID no. 5750 at SEQ ID NO. 111 with e-value of 5.80E-35 and BLAST sequence identity of 85.1

SEQ ID NO: 133 - protein, 77 aa, Ostreococcus tauri
  misc_feature (1)..(77): Public GI no. 55978016
  misc_feature (1)..(72): Pfam Name: CKS Pfam Description: Cyclin-dependent kinase regulatory subunit
  misc_feature (1)..(77): Functional Homolog of  Ceres CLONE ID no. 5750 at SEQ ID NO. 111 with e-value of 2.09E-30 and BLAST sequence identity of 83.0
MPQIQYSEKYYDDVYEYRHVVLPPDIAKLLPKNRLLTETEWRGLGVQQSRGWVHYAIHRPEPHIMLYRRPLTETPPQ

SEQ ID NO: 134 - protein, 88 aa, Zea mays
  misc_feature (1)..(88): Ceres CLONE ID no. 1436585
  misc_feature (1)..(72): Pfam Name: CKS Pfam Description: Cyclin-dependent kinase regulatory subunit
  misc_feature (1)..(88): Functional Homolog of  Ceres CLONE ID no. 5750 at SEQ ID NO. 111 with e-value of 2.49E-34 and BLAST sequence identity of 82.7
MEQIQYSEKYYDDTYEYRHVVLPPEVAKLLPRNILLSEKQWRLVGVQQSRGWVHYAIHRPEPHIMLFRRPINYQQQQDEAAAAHVLPK

SEQ ID NO: 135 - DNA, 1791 bp, Zea mays
  misc_feature (1)..(1791): Ceres CLONE ID no. 218626
  misc_feature (1)..(1791): Ceres SEED LINE: ME02065
  misc_feature: Encodes the peptide sequence given in SEQ ID no. 136
aaatcctcctcctcctcctgccgcagcccgcagggaggtggagttgtcaacgtgccgaggactggagcgcccgcgtccggcgtctctataaacgagaccgcccggccatttggtctgctcctctctgttctcccctgcctgcctgcttccagctgcatctctctccgccgagaccgagaggaggaggaggcaagggaggcatccctgacgtacggacggcggccatggggacgcaggcgccggagaactaccccgccgagaaggtacaggacgcgaggagcgcgcgggagaaggccatcgacgactggctcccgatcacctcgtcgcggaacgccaagtggtggtactccgccttccacaatgtcaccgccatggtcggcgccggcgtgctcagcctgccctacgccatgtccgagcttggctggggccctggcatcgcggtgctggtggtgtcgtgggtgatcacgctgtacacgctgtggcagatggtggagatgcacgagatggtccccgggaagcggttcgaccgttaccacgagctggggcagcacgcgttcggggaccggctgggcctgtggatcgtggtgccgcagcagctggtcgtcgaggtgggcgtgaacatcgtgtacatggtgaccggcggcaagtccctgaagaagttccacgacgtgctggtgtgcggcgacacgggggtgtgcgaggggaaggacaacatcaagaccacctacttcatcatgatcttcgcgtccgtccacttcgtcctctcgcagctccccaacttcaactccatctccggcgtctccctcgccgccgccgtcatgtcgctcagctactccaccatcgcgtggggcgcgtcggtgcacaaggggaggatgtcgggcgtcgactaccacctgcgcgcgaccaccacgccggggaaggtgttcggcttcttcggcgcgctgggggacgtggcgttcgcctacgccggccacaacgtggtgctggagatccaggccaccatcccgtccacccccgacaagccgtccaagaagcccatgtggaagggcgtggtggtcgcctacgtcgtggtggcgctctgctacttccccgtcgcgctcatcggctactgggcgttcggaaacacggtcgaggacaacatcctcatcacgctcagcaagcccaagtggctcatcgcgctcgccaacatgatggtcgtcgtccatgtcatcggcagctaccagatctatgccatgccggtgtttgacatgatagagaccgtgctggtgaagaagctgcgcttccctcccggcctcacgctgcgtctgatcgctcggaccctctatgttgcgttcacgatgttcatagccatcaccttccccttcttcggtgggctgctcggtttcttcggcgggttcgccttcgcgccgaccacctatttccttccctgcgtcatgtggctcgcaatctacaagcccaagaggttcagcctctcctggttgaccaactggatgtgcatcattcttggggtgctcctgatgattctgtcgcccatcggagggctccggcaaataataatggacgcgaaaacctaccagttctactcgtgagctaccaccagccatgacttgtaagcacgattggagaaatctgtcaaagcctcaaccacgagtttttgtttttgttttttgtcatgccaaacacatacatatacgtactgtttttttaatattcaaaggtgttcttcgtggcttgcgtgtgtacagtattatgtgtatgagggagacataagtttaatgatgctggctgtct

SEQ ID NO: 136 - protein, 454 aa, Zea mays
  misc_feature (1)..(454): Ceres CLONE ID no. 218626
  misc_feature (49)..(84): Pfam Name: Trp_Tyr_perm Pfam Description: Tryptophan/tyrosine permease family
  misc_feature (1)..(454): Ceres SEED LINE: ME02065
MGTQAPENYPAEKVQDARSAREKAIDDWLPITSSRNAKWWYSAFHNVTAMVGAGVLSLPYAMSELGWGPGIAVLVVSWVITLYTLWQMVEMHEMVPGKRFDRYHELGQHAFGDRLGLWIVVPQQLVVEVGVNIVYMVTGGKSLKKFHDVLVCGDTGVCEGKDNIKTTYFIMIFASVHFVLSQLPNFNSISGVSLAAAVMSLSYSTIAWGASVHKGRMSGVDYHLRATTTPGKVFGFFGALGDVAFAYAGHNVVLEIQATIPSTPDKPSKKPMWKGVVVAYVVVALCYFPVALIGYWAFGNTVEDNILITLSKPKWLIALANMMVVVHVIGSYQIYAMPVFDMIETVLVKKLRFPPGLTLRLIARTLYVAFTMFIAITFPFFGGLLGFFGGFAFAPTTYFLPCVMWLAIYKPKRFSLSWLTNWMCIILGVLLMILSPIGGLRQIIMDAKTYQFYS

SEQ ID NO: 137 - protein, 441 aa, Oryza sativa subsp. indica
  misc_feature (1)..(441): Public GI no. 30409136
  misc_feature (41)..(76): Pfam Name: Trp_Tyr_perm Pfam Description: Tryptophan/tyrosine permease family
  misc_feature (1)..(441): Functional Homolog of  Ceres CLONE ID no. 218626 at SEQ ID NO. 136 with e-value of 3.90E-219 and BLAST sequence identity of 91.9
MAKQWWQDGRSAQEKAIDDWLPITSSRNAKWWYSAFHNVTAMVGAGVLSLPYAMSELGWGPGIAVLILSWIITLYTLWQMVEMHEMVPGKRFDRYHELGQHAFGEKLGLWIVVPQQLVVEVGVNIVYMVTGGKSLKKFHDVLCEGHGCKNIKLTYFIMIFASVHFVLSQLPNFNSISGVSLAAAVMSLSYSTIAWGASVDKGKVADVDYHLRATTSTGKVFGFFSALGDVAFAYAGHNVVLEIQATIPSTPEKPSKKPMWKGVVVAYIIVALCYFPVALVGYWAFGNHVDDNILITLSRPKWLIALANMMVVIHVIGSYQIYAMPVFDMIETVLVKKLRFPPGLTLRLIARTLYVAFTMFIAITFPFFGGLLGFFGGFAFAPTTYFLPCIMWLAIYKPRRFSLSWFTNWICIILGVMLMILSPIGGLRQIIIDAKTYKFYS

SEQ ID NO: 138 - protein, 447 aa, Oryza sativa subsp. japonica
  misc_feature (1)..(447): Public GI no. 50940751
  misc_feature (47)..(82): Pfam Name: Trp_Tyr_perm Pfam Description: Tryptophan/tyrosine permease family
  misc_feature (1)..(447): Functional Homolog of  Ceres CLONE ID no. 218626 at SEQ ID NO. 136 with e-value of 3.29E-222 and BLAST sequence identity of 91.0
MGTQVADNYPPAKDGRSAQEKAIDDWLPITSSRNAKWWYSAFHNVTAMVGAGVLSLPYAMSELGWGPGIAVLILSWIITLYTLWQMVEMHEMVPGKRFDRYHELGQHAFGEKLGLWIVVPQQLVVEVGVNIVYMVTGGKSLKKFHDVLCEGHGCKNIKLTYFIMIFASVHFVLSQLPNFNSISGVSLAAAVMSLSYSTIAWGASVDKGKVADVDYHLRATTSTGKVFGFFSALGDVAFAYAGHNVVLEIQATIPSTPEKPSKKPMWKGVVVAYIIVALCYFPVALVGYWAFGNHVDDNILITLSRPKWLIALANMMVVIHVIGSYQIYAMPVFDMIETVLVKKLRFPPGLTLRLIARTLYVAFTMFIAITFPFFGGLLGFFGGFAFAPTTYFLPCIMWLAIYKPRRFSLSWFTNWICIILGVMLMILSPIGGLRQIIIDAKTYKFYS

SEQ ID NO: 139 - protein, 463 aa, Zea mays
  misc_feature (1)..(463): Ceres CLONE ID no. 1571117
  misc_feature (45)..(450): Pfam Name: Aa_trans Pfam Description: Transmembrane amino acid transporter protein
  misc_feature (1)..(463): Functional Homolog of  Ceres CLONE ID no. 218626 at SEQ ID NO. 136 with e-value of 3.70E-207 and BLAST sequence identity of 84.9
MTTQQGPPAASYSPARDGGGGRSAEDEEKEKAAAIDNWLPISATRNAKWWYSAFHNVTAMVGAGVLGLPYAMSQLGWGAGITIMLLSWVITLYTLWQMVEMHEMVPGKRFDRYHELGQHAFGDRLGLWIVVPQQLVVEVGVNIVYMVTGGTSLQKFHDVLVCGDAACEGGRKIRLTYFIMIFASCHFVLAQLPNFDSISGVSLAAAVMSLSYSTIAWGASVSKGRVPDVDYGLRATTPPGKVFGFLGALGTVAFAYAGHNVVLEIQATIPSTPEKPSKKPMWKGVVVAYLVVALCYFPVSFVGYWAFGDSVDGDILVTLNRPRWLIALANMMVVIHVIGSYQIYAMPVFDMIETVLVKKLRFPPGLTLRLIARTVYVAFTMFIAITFPFFDGLLSFFGGFAFAPTTYFLPCIMWLAIYKPKRFSLSWFTNWICIILGVLLMVLAPIGGLRQIIISAKTYKFYQ

SEQ ID NO: 140 - protein, 446 aa, Zea mays
  misc_feature (1)..(446): Ceres CLONE ID no. 424395
  misc_feature (31)..(433): Pfam Name: Aa_trans Pfam Description: Transmembrane amino acid transporter protein
  misc_feature (1)..(446): Functional Homolog of  Ceres CLONE ID no. 218626 at SEQ ID NO. 136 with e-value of 2.50E-201 and BLAST sequence identity of 83.9
MQEQDVDDGGGRTTQQQEKSIDDWLPINSSRKAKWWYSAFHNVTAMVGAGVLGLPYAMSELGWGPGIAVMILSWIITLYTLWQMVEMHEMVPGKRFDRYHELGQHVFGDRLGLWIVVPQQLAVEVSLNIIYMVTGGQSLKKFHDVICDGGRCGGDLKLSYFIMIFASVHLVLSQLPNFNSISAVSLAAAVMSLSYSTIAWGASLHRGRREDVDYHLRATTTPGKVFGFLGGLGDVAFAYSGHNVVLEIQATIPSTPDKPSKKAMWKGAFVAYVVVAICYFPVTFVGYWAFGSGVDENILITLSKPKWLIALANMMVVVHVIGSYQVYAMPVFDMIETVLVKKMRFAPSLTLRLIARSVYVAFTMFLGITFPFFGGLLSFFGGLAFAPTTYFLPCIMWLKVYKPKRFGLSWFINWICIVIGVLLLILGPIGGLRQIILSATTYKFYQ

SEQ ID NO: 141 - DNA, 1539 bp, Populus balsamifera subsp. trichocarpa
  misc_feature (1)..(1539): Ceres ANNOT ID no. 1440705
  misc_feature (1)..(1539): Functional Homolog of  Ceres CLONE ID no. 218626 at SEQ ID NO. 136 with e-value of 1.70E-161 and BLAST sequence identity of 81.8
  misc_feature: Encodes the peptide sequence at SEQ ID No. 142
atgggtactcaagttcctgataatcaaaaacctgatgtccccgaggaattatcagaagcagatagaaggaagaaagagattgatgattggcttccaatcacttcctcgagaaatgcaaaatggtggtattcagctttccacaatgttacggccatggttggagctggtgtcctcagtcttccatatgcaatggcaaatcttggatggggccctggtaccgtaattcttgtgctctcatggaccatcactttgtacaccctatggcaaatggttgagatgcatgagatggttcctgggaaacgatttgaccgataccatgagcttggccagcatgcctttggtgaaaaacttggtctttacatagtagtgccccagcagcttatttgtgaagtaggggttgacatagtctacatggttactggaggaaaatcacttcagaagatccacaatttagtgtgcaaagactgtgcaccgatcaaattaacctactttatcatgattttcgcctcggttcatttcgtgctttctcatcttcccaactttaactccatctctggtgtttcactggctgctgcagtcatgtctttgagttactctaccattgcatggtcagcttctgtccacaaaggtgttcagccagatgtcgactatggctacaaagcctcgacaacttctggaacggtcttcaatttcttttctgccttgggcgatgtagcttttgcctatgctgggcacaacgttgtgttagagattcaagcaacaattccatctaaaccaggcaagccatcgaaagggccaatgtggaaaggagtggtggttgcctatatagttgtagcattgtgctacttcccagttgctctgatagggtattacatgttcggtaataaagtcgaagataacatactcatatcgttagaaaaaccaacatggctcatcgtagcagctaacatgttcgtcgttatccacgttatcggaagctatcagatatatgcaattccagtatttgacatgctagaaacattgctggtaaagaagttgcatttcaggccttccagaaagcttcgattcattacacgcaatatatatgttgcgtttacaatgttcgttggcatctgcttccctttctttggtggtcttctgggattcttcggaggatttgcttttgccccaacaacttactttctaccttgtatcatgtggctggccatctacaaaccaaagaggttcagcttatcatggatcaccaactggtgtctggatttgaggactaaccttgtctcggattctttgtttcctatgaaacgccatggaaggaattctggagtcactttaatatcatcaacattttgcataggtcttggaggtcatgattcctcgctgtcattctcacaactcatctctcgtggttttggaagagcttactcgtgcaatgtagacatcttagttcgatttccactctacaatttctctgaaccatgcttcaagattgttgtatggtatagggaattttctcaccaaaagctactgttgaagagttaa

SEQ ID NO: 142 - protein, 461 aa, Populus balsamifera subsp. trichocarpa
  misc_feature (1)..(461): Ceres ANNOT ID no. 1440705
  misc_feature (1)..(35): Pfam Name: Trp_Tyr_perm Pfam Description: Tryptophan/tyrosine permease family
  misc_feature (1)..(461): Functional Homolog of  Ceres CLONE ID no. 218626 at SEQ ID NO. 136 with e-value of 1.70E-161 and BLAST sequence identity of 81.8
MVGAGVLSLPYAMANLGWGPGTVILVLSWTITLYTLWQMVEMHEMVPGKRFDRYHELGQHAFGEKLGLYIVVPQQLICEVGVDIVYMVTGGKSLQKIHNLVCKDCAPIKLTYFIMIFASVHFVLSHLPNFNSISGVSLAAAVMSLSYSTIAWSASVHKGVQPDVDYGYKASTTSGTVFNFFSALGDVAFAYAGHNVVLEIQATIPSKPGKPSKGPMWKGVVVAYIVVALCYFPVALIGYYMFGNKVEDNILISLEKPTWLIVAANMFVVIHVIGSYQIYAIPVFDMLETLLVKKLHFRPSRKLRFITRNIYVAFTMFVGICFPFFGGLLGFFGGFAFAPTTYFLPCIMWLAIYKPKRFSLSWITNWCLDLRTNLVSDSLFPMKRHGRNSGVTLISSTFCIGLGGHDSSLSFSQLISRGFGRAYSCNVDILVRFPLYNFSEPCFKIVVWYREFSHQKLLLKS

SEQ ID NO: 143 - DNA, 1350 bp, Populus balsamifera subsp. trichocarpa
  misc_feature (1)..(1350): Ceres ANNOT ID no. 1493584
  misc_feature (1)..(1350): Functional Homolog of  Ceres CLONE ID no. 218626 at SEQ ID NO. 136 with e-value of 4.19E-174 and BLAST sequence identity of 81.6
  misc_feature: Encodes the peptide sequence at SEQ ID No. 144
atgggtactcaagttcctgataatcaaaaacctgatgtccccgaggaattatcagaagcagatagaaggaagaaagagattgatgattggcttccaatcacttcctcgagaaatgcaaaatggtggtattcagctttccacaatgttacggccatggttggagctggtgtcctcagtcttccatatgcaatggcaaatcttggatggggccctggtaccgtaattcttgtgctctcatggaccatcactttgtacaccctatggcaaatggttgagatgcatgagatggttcctgggaaacgatttgaccgataccatgagcttggccagcatgcctttggtgaaaaacttggtctttacatagtagtgccccagcagcttatttgtgaagtaggggttgacatagtctacatggttactggaggaaaatcacttcagaagatccacaatttagtgtgcaaagactgtgcaccgatcaaattaacctactttatcatgattttcgcctcggttcatttcgtgctttctcatcttcccaactttaactccatctctggtgtttcactggctgctgcagtcatgtctttgagttactctaccattgcatggtcagcttctgtccacaaaggtgttcagccagatgtcgactatggctacaaagcctcgacaacttctggaacggtcttcaatttcttttctgccttgggcgatgtagcttttgcctatgctgggcacaacgttgtgttagagattcaagcaacaattccatctaaaccaggcaagccatcgaaagggccaatgtggaaaggagtggtggttgcctatatagttgtagcattgtgctacttcccagttgctctgatagggtattacatgttcggtaataaagtcgaagataacatactcatatcgttagaaaaaccaacatggctcatcgtagcagctaacatgttcgtcgttatccacgttatcggaagctatcagatatatgcaattccagtatttgacatgctagaaacattgctggtaaagaagttgcatttcaggccttccagaaagcttcgattcattacacgcaatatatatgttgcgtttacaatgttcgttggcatctgcttccctttctttggtggtcttctgggattcttcggaggatttgcttttgccccaacaacttactttctaccttgtatcatgtggctggccatctacaaaccaaagaggttcagcttatcatggatcaccaactggatctgcattatacttggctttttattgatgattttgtcacctattggagggttgcggactatcatactaaatgccaagggctacaaatttttctcttga

SEQ ID NO: 144 - protein, 398 aa, Populus balsamifera subsp. trichocarpa
  misc_feature (1)..(398): Ceres ANNOT ID no. 1493584
  misc_feature (1)..(35): Pfam Name: Trp_Tyr_perm Pfam Description: Tryptophan/tyrosine permease family
  misc_feature (1)..(398): Functional Homolog of  Ceres CLONE ID no. 218626 at SEQ ID NO. 136 with e-value of 4.19E-174 and BLAST sequence identity of 81.6
MVGAGVLSLPYAMANLGWGPGTVILVLSWTITLYTLWQMVEMHEMVPGKRFDRYHELGQHAFGEKLGLYIVVPQQLICEVGVDIVYMVTGGKSLQKIHNLVCKDCAPIKLTYFIMIFASVHFVLSHLPNFNSISGVSLAAAVMSLSYSTIAWSASVHKGVQPDVDYGYKASTTSGTVFNFFSALGDVAFAYAGHNVVLEIQATIPSKPGKPSKGPMWKGVVVAYIVVALCYFPVALIGYYMFGNKVEDNILISLEKPTWLIVAANMFVVIHVIGSYQIYAIPVFDMLETLLVKKLHFRPSRKLRFITRNIYVAFTMFVGICFPFFGGLLGFFGGFAFAPTTYFLPCIMWLAIYKPKRFSLSWITNWICIILGFLLMILSPIGGLRTIILNAKGYKFFS

SEQ ID NO: 145 - DNA, 1434 bp, Populus balsamifera subsp. trichocarpa
  misc_feature (1)..(1434): Ceres ANNOT ID no. 1463076
  misc_feature (1)..(1434): Functional Homolog of  Ceres CLONE ID no. 218626 at SEQ ID NO. 136 with e-value of 1.80E-159 and BLAST sequence identity of 79.2
  misc_feature: Encodes the peptide sequence at SEQ ID No. 146
atgccatccaatgagtcacagaacgatgaagcagcaagagaaaaggccataaatgattggcttccagtcacttcctcgaggaatgccaaatggtggtactcaaccttccacaatgtcactgccatggttggtgctggtgttcttagtctcccctatgccatggctcaacttggatggggaccaggtgttgccatactttttttatcatgggtgatcacgttatacactctatggcaaatggttgaaatgcatgagatggttcctggtaagcgatttgatagataccatgagctagggcaacatgcgtttggagagaagctgggtctctggattgttgtgccacagcaactagttgtacaagttggagtaaacatagtctatatggttaccggaggaaaatcattgaagaagttccatgatttggtttgctccgactgcaaagacatcaggctaacgtacttcatcatgattttcgcttcgcttcagtttgttctggctcatcttcccaatctcaactccattagtgttatctctctggctgcagcagtcatgtccttgagttactccacaattgcctggggagccacccttaataagggtgttcagcctgatgtcgactacagctataaagcgagcactaaaaccggagctgtctttgactttttctctgccttgggtgatatagcttttgcatatgccggtcacaatgtgatcttggagatccaagcaacaattccctctactccagagaagccttccaagaaacccatgtggagaggagccttccttgcatatgttgtcgtcgccatctgctacttcccagttgccttgattggatactggttttttggaaacagcgtggaagacaacattcttatctcactcgagaaaccagcttggcttattgcaactgctaacatgtttgttgtcattcatgttattggaagttatcagatatatgctatggcagtgttcgacatgttggaaactgcattggtgaagaaactccatttttctccttctttcatgcttcgctttgttactcgcacggtatatgttgggttcacaatgattgttggtatatgtattccattcttcggtggcctgctttcgttcttcggaggatttgcttttgccccaacaacatactttctcccttgcatcatgtggcttgccatctataaacccaagaagttcagcttctcttggatagcaaattgggtgcgtctgcattgtgcttggaattttgctgatgatattgtcacccattggtgccctaagacatatcatccttacagccaaagactacgagttcttctcatgagcatcacaccaaatgcgagacaagggcagaccaagtactgtaaagaaagggtgttgattgagttgctggttatggcctttgcacttagcaggaaactcaaatttaattaa

SEQ ID NO: 146 - protein, 436 aa, Populus balsamifera subsp. trichocarpa
  misc_feature (1)..(436): Ceres ANNOT ID no. 1463076
  misc_feature (1)..(35): Pfam Name: Trp_Tyr_perm Pfam Description: Tryptophan/tyrosine permease family
  misc_feature (1)..(436): Functional Homolog of  Ceres CLONE ID no. 218626 at SEQ ID NO. 136 with e-value of 1.80E-159 and BLAST sequence identity of 79.2
MVGAGVLSLPYAMAQLGWGPGVAILFLSWVITLYTLWQMVEMHEMVPGKRFDRYHELGQHAFGEKLGLWIVVPQQLVVQVGVNIVYMVTGGKSLKKFHDLVCSDCKDIRLTYFIMIFASLQFVLAHLPNLNSISVISLAAAVMSLSYSTIAWGATLNKGVQPDVDYSYKASTKTGAVFDFFSALGDIAFAYAGHNVILEIQATIPSTPEKPSKKPMWRGAFLAYVVVAICYFPVALIGYWFFGNSVEDNILISLEKPAWLIATANMFVVIHVIGSYQIYAMAVFDMLETALVKKLHFSPSFMLRFVTRTVYVGFTMIVGICIPFFGGLLSFFGGFAFAPTTYFLPCIMWLAIYKPKKFSFSWIANWVRLHCAWNFADDIVTHWCPKTYHPYSQRLRVLLMSITPNARQGQTKYCKERVLIELLVMAFALSRKLKFN

SEQ ID NO: 147 - protein, 398 aa, Arabidopsis thaliana
  misc_feature (1)..(398): Ceres CLONE ID no. 1002421
  misc_feature (1)..(385): Pfam Name: Aa_trans Pfam Description: Transmembrane amino acid transporter protein
  misc_feature (1)..(398): Functional Homolog of  Ceres CLONE ID no. 218626 at SEQ ID NO. 136 with e-value of 9.99E-171 and BLAST sequence identity of 79.1
MVGAGVLGLPYAMSQLGWGPGIAVLVLSWVITLYTLWQMVEMHEMVPGKRFDRYHELGQHAFGEKLGLYIVVPQQLIVEIGVCIVYMVTGGKSLKKFHELVCDDCKPIKLTYFIMIFASVHFVLSHLPNFNSISGVSLAAAVMSLSYSTIAWASSASKGVQEDVQYGYKAKTTAGTVFNFFSGLGDVAFAYAGHNVVLEIQATIPSTPEKPSKGPMWRGVIVAYIVVALCYFPVALVGYYIFGNGVEDNILMSLKKPAWLIATANIFVVIHVIGSYQIYAMPVFDMMETLLVKKLNFRPTTTLRFFVRNFYVAATMFVGMTFPFFGGLLAFFGGFAFAPTTYFLPCVIWLAIYKPKKYSLSWWANWVCIVFGLFLMVLSPIGGLRTIVIQAKGYKFYS

SEQ ID NO: 148 - DNA, 1251 bp, Populus balsamifera subsp. trichocarpa
  misc_feature (1)..(1251): Ceres ANNOT ID no. 1516369
  misc_feature (1)..(1251): Functional Homolog of  Ceres CLONE ID no. 218626 at SEQ ID NO. 136 with e-value of 1.20E-153 and BLAST sequence identity of 78.6
  misc_feature: Encodes the peptide sequence at SEQ ID No. 149
atgccatccaatgagtcacagaacgatgaagcagcaagagaaaaggccataaatgattggcttccagtcacttcctcgaggaatgccaaatggtggtactcaaccttccacaatgtcactgccatggttggtgctggtgttcttagtctcccctatgccatggctcaacttggatggggaccaggtgttgccatactttttttatcatgggtgatcacgttatacactctatggcaaatggttgaaatgcatgagatggttcctggtaagcgatttgatagataccatgagctagggcaacatgcgtttggagagaagctgggtctctggattgttgtgccacagcaactagttgtacaagttggagtaaacatagtctatatggttaccggaggaaaatcattgaagaagttccatgatttggtttgctccgactgcaaagacatcaggctaacgtacttcatcatgattttcgcttcgcttcagtttgttctggctcatcttcccaatctcaactccattagtgttatctctctggctgcagcagtcatgtccttgagttactccacaattgcctggggagccacccttaataagggtgttcagcctgatgtcgactacagctataaagcgagcactaaaaccggagctgtctttgactttttctctgccttgggtgatatagcttttgcatatgccggtcacaatgtgatcttggagatccaagcaacaattccctctactccagagaagccttccaagaaacccatgtggagaggagccttccttgcatatgttgtcgtcgccatctgctacttcccagttgccttgattggatactggttttttggaaacagcgtggaagacaacattcttatctcactcgagaaaccagcttggcttattgcaactgctaacatgtttgttgtcattcatgttattggaagttatcagatatatgctatggcagtgttcgacatgttggaaactgcattggtgaagaaactccatttttctccttctttcatgcttcgctttgttactcgcacggtatatgttgggttcacaatgattgttggtatatgtattccattcttcggtggcctgctttcgttcttcggaggatttgcttttgccccaacaacatactttgtctgcattgtgcttggaattttgctgatgatattgtcacccattggtgccctaagacatatcatccttacagccaaagactacgagttcttctcatga

SEQ ID NO: 149 - protein, 375 aa, Populus balsamifera subsp. trichocarpa
  misc_feature (1)..(375): Ceres ANNOT ID no. 1516369
  misc_feature (1)..(35): Pfam Name: Trp_Tyr_perm Pfam Description: Tryptophan/tyrosine permease family
  misc_feature (343)..(362): Pfam Name: Aa_trans Pfam Description: Transmembrane amino acid transporter protein
  misc_feature (1)..(375): Functional Homolog of  Ceres CLONE ID no. 218626 at SEQ ID NO. 136 with e-value of 1.20E-153 and BLAST sequence identity of 78.6
MVGAGVLSLPYAMAQLGWGPGVAILFLSWVITLYTLWQMVEMHEMVPGKRFDRYHELGQHAFGEKLGLWIVVPQQLVVQVGVNIVYMVTGGKSLKKFHDLVCSDCKDIRLTYFIMIFASLQFVLAHLPNLNSISVISLAAAVMSLSYSTIAWGATLNKGVQPDVDYSYKASTKTGAVFDFFSALGDIAFAYAGHNVILEIQATIPSTPEKPSKKPMWRGAFLAYVVVAICYFPVALIGYWFFGNSVEDNILISLEKPAWLIATANMFVVIHVIGSYQIYAMAVFDMLETALVKKLHFSPSFMLRFVTRTVYVGFTMIVGICIPFFGGLLSFFGGFAFAPTTYFVCIVLGILLMILSPIGALRHIILTAKDYEFFS

SEQ ID NO: 150 - protein, 445 aa, Arabidopsis thaliana
  misc_feature (1)..(445): Public GI no. 30693666
  misc_feature (33)..(432): Pfam Name: Aa_trans Pfam Description: Transmembrane amino acid transporter protein
  misc_feature (1)..(445): Functional Homolog of  Ceres CLONE ID no. 218626 at SEQ ID NO. 136 with e-value of 3.40E-188 and BLAST sequence identity of 78.3
MVAQAPHDDHDDEKLAAARQKEIEDWLPITSSRNAKWWYSAFHNVTAMVGAGVLGLPYAMSQLGWGPGIAVLVLSWVITLYTLWQMVEMHEMVPGKRFDRYHELGQHAFGEKLGLYIVVPQQLIVEIGVCIVYMVTGGKSLKKFHELVCDDCKPIKLTYFIMIFASVHFVLSHLPNFNSISGVSLAAAVMSLSYSTIAWASSASKGVQEDVQYGYKAKTTAGTVFNFFSGLGDVAFAYAGHNVVLEIQATIPSTPEKPSKGPMWRGVIVAYIVVALCYFPVALVGYYIFGNGVEDNILMSLKKPAWLIATANIFVVIHVIGSYQIYAMPVFDMMETLLVKKLNFRPTTTLRFFVRNFYVAATMFVGMTFPFFGGLLAFFGGFAFAPTTYFLPCVIWLAIYKPKKYSLSWWANWVCIVFGLFLMVLSPIGGLRTIVIQAKGYKFYS

SEQ ID NO: 151 - DNA, 1262 bp, Arabidopsis thaliana
  misc_feature (1)..(1262): Ceres CLONE ID no. 121021
  misc_feature (1)..(1262): Ceres SEED LINE: ME02525
  misc_feature: Encodes the peptide sequence given in SEQ ID no. 152
aatgggcaacataaataaaaagtaaaagggctctctctcctttctttcagtttcgacattccccagaatctctcttccctttttgtctccaaccaaaacaaaaccttaatcacctttcttcttcttcaaacagagcacaacagagacgttcgttcccactctgtcttaatctcccctgtttcaattcctaaatcgatggaaaacggtggaacaattccgggtcaagaaatcggatcagggcttcaaaaacccgttaacccagatgggtttgtgacgatcgatgttgaaagtttctctagtgtcatccacaaagacttctcttcttctagtccaagaattactttgcagaggaatgtatcgaggaaagggtctccaagaagcaacaacgagagaaaactccattttgacgcaaatggtaatgacaaggagatctcatttcctcagtccccacttagagggtcaagcacgccggaaaaggctagcaccgtgggccccacagaacatgcaggcacggccacaaccgctgccacagctgtttcagcctcgccgcttcatcagatcaccgttactacggctgccacggccgcaggaaatatgattaccgaccaaaatagagaaagaaggttcggtttttcgaggaaatcgagttttaaacgctctcacacttcttggatgcttgatccgaagaaaatcgtcctcttctttgcaactttgtcaagcatgggatcaatcttgttaatcatattcacactctcgatcagcaagtccaatcccggagatatgcctctagactaatagtaaacacacgaagagcattatatataacgcatatatatcatcgaccgacctaagtttgtggccatagaacatgccacagtctcaccgacctacattttaaggagatgtatcagacagaagaacattacaaaaaatgaagagggtaaggttgtgataatagttttatttcgtatgattttttttaaatgaaaaaaaagaagaagacaacagtaagagagagagaaagtgggaagtgggcacgcacgagatcatatgggagattggaaaagaaagcttaagacaagagtttatgactattgtgacaaagacagagaatcttctcttctgttctttcaaattcttttttctctgttttttctttaaatttatttatcgagtatgtgtttcgattgtcttcaatatgttctctatgtgtacatatcaattgcggtgactggtgagcaattttagtttcgtttggtttt

SEQ ID NO: 152 - protein, 199 aa, Arabidopsis thaliana
  misc_feature (1)..(199): Ceres CLONE ID no. 121021
  misc_feature (1)..(199): Ceres SEED LINE: ME02525
MENGGTIPGQEIGSGLQKPVNPDGFVTIDVESFSSVIHKDFSSSSPRITLQRNVSRKGSPRSNNERKLHFDANGNDKEISFPQSPLRGSSTPEKASTVGPTEHAGTATTAATAVSASPLHQITVTTAATAAGNMITDQNRERRFGFSRKSSFKRSHTSWMLDPKKIVLFFATLSSMGSILLIIFTLSISKSNPGDMPLD

SEQ ID NO: 153 - DNA, 531 bp, Populus balsamifera subsp. trichocarpa
  misc_feature (1)..(531): Ceres ANNOT ID no. 1501628
  misc_feature (1)..(531): Functional Homolog of  Ceres CLONE ID no. 121021 at SEQ ID NO. 152 with e-value of 1.79E-17 and BLAST sequence identity of 57.6
  misc_feature: Encodes the peptide sequence at SEQ ID No. 154
atggcgtataatccaaaggtgactatggattcgtctggtggagatggtggattgctcttagaagaaaccatggaagcacaaaaactcactgttttggatcgtatagatggatttcaatacacaaaggagaaatcagatagctttattattgacatggaaagtttctctcatggcatcaataaagatatcaatacaaatcaaagaatcacaaggaacctttcaagaaaagggtcaccacggggcggtggtggcggcgggcctagcacgcctgaaaaggctgcggtggtaacggtggggaccccagatcattccagtagcccacaagttcatcatcaaatcactatcacgaccggcagcatcaatggcaccccagaaggcagatgcattaggagaaacagtttcaagcgcgcatcaccttcctgggtccttgatcccaaaagggttcttttcttctttgccacactgtcgagtatgggaacaatgttgctgatatacctcactctttcaattgggaagctcaaaacagattga

SEQ ID NO: 154 - protein, 168 aa, Populus balsamifera subsp. trichocarpa
  misc_feature (1)..(168): Ceres ANNOT ID no. 1501628
  misc_feature (1)..(168): Functional Homolog of  Ceres CLONE ID no. 121021 at SEQ ID NO. 152 with e-value of 1.79E-17 and BLAST sequence identity of 57.6
MDSSGGDGGLLLEETMEAQKLTVLDRIDGFQYTKEKSDSFIIDMESFSHGINKDINTNQRITRNLSRKGSPRGGGGGGPSTPEKAAVVTVGTPDHSSSPQVHHQITITTGSINGTPEGRCIRRNSFKRASPSWVLDPKRVLFFFATLSSMGTMLLIYLTLSIGKLKTD

SEQ ID NO: 155 - DNA, 633 bp, Populus balsamifera subsp. trichocarpa
  misc_feature (1)..(633): Ceres ANNOT ID no. 1519046
  misc_feature (1)..(633): Functional Homolog of  Ceres CLONE ID no. 121021 at SEQ ID NO. 152 with e-value of 7.69E-24 and BLAST sequence identity of 52.8
  misc_feature: Encodes the peptide sequence at SEQ ID No. 156
atggcggataatccaaagttggatatggattcatcaagtgaagctggtgggggtggtggcttcgcattagaagaacacatggaagcacaaaaaatctcagtcttagatcatataaatggatttcaatgcacaaaggagaaatcagatagctttgttattgacatggaaagattctctcacggcataaataaagatagcaatacaaattcaaggatcacaaggagccattccagaaaagggtcaccgcgggggggcggaggcggcgagaagaagataaattctaatctttctcatctttctgttagtgatagagatgctattgttgcttcagcttcacctagagggcctagcacgccagaaaaggcagcggcggtaacggtagggacggcagatcattccagtagcccacaacttcatcatcaaatcacaatcacgaccggcaacatgaatgccactccagaaagtagatgcattaggagaaatagtttcaagcggtcttcaccttcatgggtccttgatcccaaaagggttcttttcttctttgccacactgtcaagtatgggaacaatgttgctgatatacctcactctttcaattgggaagctcaatgcaattgataattcccttgattga

SEQ ID NO: 156 - protein, 202 aa, Populus balsamifera subsp. trichocarpa
  misc_feature (1)..(202): Ceres ANNOT ID no. 1519046
  misc_feature (1)..(202): Functional Homolog of  Ceres CLONE ID no. 121021 at SEQ ID NO. 152 with e-value of 7.69E-24 and BLAST sequence identity of 52.8
MDSSSEAGGGGGFALEEHMEAQKISVLDHINGFQCTKEKSDSFVIDMERFSHGINKDSNTNSRITRSHSRKGSPRGGGGGEKKINSNLSHLSVSDRDAIVASASPRGPSTPEKAAAVTVGTADHSSSPQLHHQITITTGNMNATPESRCIRRNSFKRSSPSWVLDPKRVLFFFATLSSMGTMLLIYLTLSIGKLNAIDNSLD

SEQ ID NO: 157 - protein, 203 aa, Glycine max
  misc_feature (1)..(203): Ceres CLONE ID no. 1121512
  misc_feature (1)..(203): Functional Homolog of  Ceres CLONE ID no. 121021 at SEQ ID NO. 152 with e-value of 9.09E-21 and BLAST sequence identity of 51.7
  misc_feature (109)..(109): Xaa is any aa, unknown, or other
MAEIPKLDLSSSCFDNGEPLDSEQKSQKIFVSDHINAFQYADEKADSFVIDMDAFSSGHNKDATNANSRITLQRSLSRKGSQRLGDWKLNNNATLYDKDTVPAICSPKXTLVGPFTPEKPAGMAVGPMGHSMNPHVHNLTADNIPTESKCSITRRNSFRRPSSWAIDPKRVLLFFATLSSMGTMLLIYFTLTISKQSAEEYGG

SEQ ID NO: 158 - DNA, 1063 bp, Arabidopsis thaliana
  misc_feature (1)..(1063): Ceres CLONE ID no. 158765
  misc_feature (1)..(1063): Ceres SEED LINE: ME02505
  misc_feature: Encodes the peptide sequence given in SEQ ID no. 159
ctctttccttttctcacgccgagatttctgcgactgctctagtcttacgaccttataagaaacgacgctattttcactctgcttgagctcttcatcgtgtcacacagcacgatcttggacgtcgttttaagcgcaaaacaaaggaaaaagactgacgtttatacatactaaataccggtttggagttttgccttttggactcagaaaactcaaaagagagagagagagagagacatttctgtatcttatcgggttttgtgttgtcagaaagaagctcaaggacaaaaaaaaaagcaattatttttagggttcaaaagaagcaaaatttggaactttcagaagttgtgggtggtggcttcttgaacaataaagctttttcttagactcttcttccaatttgtgactctacctatctctctctccaggtatggaattctctggagacgctggaatgatgatggagaacaagcggaatgtctgctctctcggagaaagcagcatcaaacgccacaagtctgatctctctttcaattccaaggagaggaaggacaaggttggagaacgtatttcagctcttcaacaaatagtttccccttatggaaagaccgacactgcatcagttcttctagacgcgatgcattacatagagtttcttcacgaacaagtgaaggtgctaagtgctccgtatctgcaaacgatacctgatgctacgcaggaggagctggagcagtacagcctgagaaacagaggattatgtcttgttccaatggagaatacagttggagttgctcaaagcaacggcgctgatatatgggcgcccgtgaagactcctctatcaccagctttcagtgtcacatctcaatcaccctttagatgaccaattcgactaatcacctactacgatctttgtgttaagcctaaaaaagaatgaccaattgttatttttctgatgatgcctctgtaacatatatagacagagagcacatgatgttggtttagaactgctcatggttggcaatgattgttattattatttgactgcttaatgcatccccttactttg

SEQ ID NO: 159 - protein, 149 aa, Arabidopsis thaliana
  misc_feature (1)..(149): Ceres CLONE ID no. 158765
  misc_feature (1)..(149): Ceres SEED LINE: ME02505
MEFSGDAGMMMENKRNVCSLGESSIKRHKSDLSFNSKERKDKVGERISALQQIVSPYGKTDTASVLLDAMHYIEFLHEQVKVLSAPYLQTIPDATQEELEQYSLRNRGLCLVPMENTVGVAQSNGADIWAPVKTPLSPAFSVTSQSPFR

SEQ ID NO: 160 - protein, 149 aa, Arabidopsis thaliana
  misc_feature (1)..(149): Public GI no. 32562996
  misc_feature (1)..(149): Functional Homolog of  Ceres CLONE ID no. 158765 at SEQ ID NO. 159 with e-value of 5.19E-73 and BLAST sequence identity of 97.9
MEFSRDAGMMMENKRNVCSLGESSIKRHKSDLSFSSKERKDKVGERISALQQIVSPYGKTDTASVLLDAMHYIEFLHEQVKVLSAPYLQTVPDATQEELEQYSLRNRGLCLVPMENTVGVAQSNGADIWAPVKTPLSPAFSVTSQSPFR

SEQ ID NO: 161 - protein, 140 aa, Lycopersicon esculentum
  misc_feature (1)..(140): Public GI no. 5669656
  misc_feature (1)..(140): Functional Homolog of  Ceres CLONE ID no. 158765 at SEQ ID NO. 159 with e-value of 5.00E-36 and BLAST sequence identity of 66.1
MPHKRSPISLEHSSSLTSLTPKRLKADMLISSKEKKEKFGERIVAPQQLVSPYGKTDTASVLLEAMGYIKFLHEQVKVLSAPYLGTMPMSKTQESQPYNLRSQGLCLVPVSYTVGVATSNGADIWAPIKTSQSSSPENDV

SEQ ID NO: 162 - protein, 169 aa, Triticum aestivum
  misc_feature (1)..(169): Ceres CLONE ID no. 754061
  misc_feature (1)..(169): Functional Homolog of  Ceres CLONE ID no. 158765 at SEQ ID NO. 159 with e-value of 6.99E-30 and BLAST sequence identity of 65.3
MMMTQVANHSKRNHTDGYFSGKQQQQQQQVGAATATSSGSEEFGRMGSKKPRSASPRGSGGPISPREKKDKVGERVAALQQLVSPFGKTDTASVLQEASGYIKFLHQQLEVLSSPYMRPPPAPGAEPEDPEHYSLRNRGLCLVPVEQTLQLTQSNGADLWAPANTSRRT

SEQ ID NO: 163 - protein, 168 aa, Triticum aestivum
  misc_feature (1)..(168): Ceres CLONE ID no. 1329861
  misc_feature (1)..(168): Functional Homolog of  Ceres CLONE ID no. 158765 at SEQ ID NO. 159 with e-value of 6.99E-30 and BLAST sequence identity of 65.3
MMMTQVANHSKRNHTDSYFSGKQQQQQQQAGATTTSGGSEEFAGMGSKKPRNASPRGSGGPISPKEKKDKVGERVAALQQLVSPFGKTDTASVLQEASGYIKFLHQQLEVLSSPYMRPPPAPGAEPEDPDHYSLRNRGLCLVPVEQTLQLTQSNGADLWAPANTTRRT

SEQ ID NO: 164 - protein, 156 aa, Glycine max
  misc_feature (1)..(156): Ceres CLONE ID no. 537752
  misc_feature (1)..(156): Functional Homolog of  Ceres CLONE ID no. 158765 at SEQ ID NO. 159 with e-value of 1.10E-40 and BLAST sequence identity of 65.1
MFSREEGIDVRKMMEHKRRPCSVDQSSYTSIASKRQKADLSISTKERKEKIGERIVALQQLVSPYGKTDTSSVLKEAMEYIGFLHKQVKLLSAPYLESSPAAKMQGVEPCSLRSRGLCLVPVSVTIGVAESNGADIWAPIKTTTSPKFEKDVSQFH

SEQ ID NO: 165 - protein, 165 aa, Triticum aestivum
  misc_feature (1)..(165): Ceres CLONE ID no. 1322549
  misc_feature (1)..(165): Functional Homolog of  Ceres CLONE ID no. 158765 at SEQ ID NO. 159 with e-value of 1.90E-29 and BLAST sequence identity of 64.2
MMMTQVANHSKRNHTDSYFSGKQQQQAVATTATSSGSEEFAGMGSKKPRNASPRGGGPISPREKKDKVGERVAALQQLVSPFGKTDTASVLQEASGYIKFLHQQLEVLSSPYMRPPPSPGAEPEDPDHYSLRNRGLCLVPVEQTLQLTQSNGADLWAPANTTRRC

SEQ ID NO: 166 - protein, 162 aa, Zea mays
  misc_feature (1)..(162): Ceres CLONE ID no. 282892
  misc_feature (1)..(162): Functional Homolog of  Ceres CLONE ID no. 158765 at SEQ ID NO. 159 with e-value of 4.90E-29 and BLAST sequence identity of 62.2
MMMAEVAANHSKRSHNDGYFSAKAAAAAAASPEELGSMSMSSKKPRNSNSPRTAPVSPKEKKDRIGERVAALQQLVSPFGKTDTASVLQEASGYIRFLHQQLQVLSSPYMRAPPAAGAAPEDTEHYSLRSRGLCLVPVDQTLQLTQSNGADLWAPANTTRRR

SEQ ID NO: 167 - protein, 155 aa, Zea mays
  misc_feature (1)..(155): Ceres CLONE ID no. 284046
  misc_feature (1)..(155): Functional Homolog of  Ceres CLONE ID no. 158765 at SEQ ID NO. 159 with e-value of 1.29E-28 and BLAST sequence identity of 62.2
MMAEVANHSKRNHTDSYFSGKAVAATSSEEFGSMSSKKPRNASPRLAPVSPKEKKDKIGERVAALQQLVSPFGKTDTASVLQEASGYIKFLHQQLEVLSSPYMRAPPAAGAAPEDPQRYSLRSRGLCLVPVDLTLQLTQSNGADLWAPAHTARRR

SEQ ID NO: 168 - protein, 169 aa, Zea mays
  misc_feature (1)..(169): Ceres CLONE ID no. 1388825
  misc_feature (1)..(169): Functional Homolog of  Ceres CLONE ID no. 158765 at SEQ ID NO. 159 with e-value of 4.90E-29 and BLAST sequence identity of 61.6
MMMAEVAANHSKRSHNDGYFSAKAAAAAAASPEELGSMSMSSKKPRNSNSPRTAPVSPKEKKDRIGERVAALQQLVSPFGKTDTASVLQEASGYIRFLHQQLQVLSSPYMRAPPAAGAAPEDTEHYSLRSRGLCLVPVDQTLQLTQSNGADLWAPATRPGAGEEEPAAG

SEQ ID NO: 169 - protein, 156 aa, Oryza sativa subsp. japonica
  misc_feature (1)..(156): Public GI no. 50925813
  misc_feature (1)..(156): Functional Homolog of  Ceres CLONE ID no. 158765 at SEQ ID NO. 159 with e-value of 1.60E-30 and BLAST sequence identity of 50.0
MMMTEVANHSKRNHNESYFTGKAAVTSSSEEFGSMTSKKPRNTSPRDAPVSPKEKKDKIGERVAALQQLVSPFGKTDTASVLQEASGYIKFLHQQLEVLSSPYMRAPPVPGAAPEDPDHYSLRNRGLCLVPVDQTLQLTQSNGADLWAPANTTRRR

SEQ ID NO: 170 - DNA, 901 bp, Arabidopsis thaliana
  misc_feature (1)..(901): Ceres CLONE ID no. 16403
  misc_feature (1)..(901): Ceres SEED LINE: ME00896
  misc_feature: Encodes the peptide sequence given in SEQ ID no. 171
gtcttgtgaattgtagccactatggcagtctcctcactctcaatccgctgtggtggtttctcaccaacaatctcccacaagacagaaattctctgtccaaatccatcactcaaagcttgttgtttactttcatccggtggtaaggccgactcctcggagagtacttaccaaaaaggcagcggaaacaattggaagagaaggcaagctcttgtgggagtaggaactttagtggcaacttcaattccagcaactttgcttcttgctgaagagataccaaaaagctactcgccttttgtggatcgagaagacgggtattcttactattacccatcagactggagggaatttgacttcagggcacatgattcagccttcaaagatagatacttgcaactgcagaatgtgcgggtcaggttcataccaacggagaaaaacgacatccatgaagtaggtcctatggaagaggtggtttatgatctagtgaagcataagtttgcagcaccaaaccaagtagctaccatctacgatatgaaagagagggtggaagatggaaagaactattacacgtttgagtatggactaagaactcctatctatgcaaccacttcctttgcaacagtggcagttggaaacaacagatactacactctcatagttggagcaaatgagagaaggtggaggaaagtgaaaaagcagcttcaagttgtggccgactctttgaagatccttcagatttgacaaacacaagaaacatcttactcctatatatctttctctctctgtggttacaaaactgtctgtagataacaatttgatattttcatattctctataactccaacgatggttttggcattgtgagttagattctgagttggttcagtaattcaatcaaacttgc

SEQ ID NO: 171 - protein, 238 aa, Arabidopsis thaliana
  misc_feature (1)..(238): Ceres CLONE ID no. 16403
  misc_feature (54)..(236): Pfam Name: PsbP Pfam Description: PsbP
  misc_feature (1)..(238): Ceres SEED LINE: ME00896
MAVSSLSIRCGGFSPTISHKTEILCPNPSLKACCLLSSGGKADSSESTYQKGSGNNWKRRQALVGVGTLVATSIPATLLLAEEIPKSYSPFVDREDGYSYYYPSDWREFDFRAHDSAFKDRYLQLQNVRVRFIPTEKNDIHEVGPMEEVVYDLVKHKFAAPNQVATIYDMKERVEDGKNYYTFEYGLRTPIYATTSFATVAVGNNRYYTLIVGANERRWRKVKKQLQVVADSLKILQI

SEQ ID NO: 172 - protein, 234 aa, Glycine max
  misc_feature (1)..(234): Ceres CLONE ID no. 611156
  misc_feature (49)..(232): Pfam Name: PsbP Pfam Description: PsbP
  misc_feature (1)..(234): Functional Homolog of  Ceres CLONE ID no. 16403 at SEQ ID NO. 171 with e-value of 7.29E-67 and BLAST sequence identity of 58.9
MVVSSCSLSWISPCLSHKLNLPHTNCLPRNIATSSSNTVFCELDTTPSGESHCRRRPLLLGIGALTANLQPTNLVFAQEKPDRYRAFVDYEDGYSYVYPIDWKEFDFRAHDSAFKDRYLQLQNVRVRFIPTEKKDIRDLGPMEEVIYDLVKHRYAAPNQRPTINDMQEKTIDGKHYYTFEYILTSPNYSSASFATIAIGNGRYYTLIVGANERRWKRFRDQLKVVADSFRLLDI

SEQ ID NO: 173 - DNA, 699 bp, Populus balsamifera subsp. trichocarpa
  misc_feature (1)..(699): Ceres ANNOT ID no. 1464944
  misc_feature (1)..(699): Functional Homolog of  Ceres CLONE ID no. 16403 at SEQ ID NO. 171 with e-value of 4.39E-60 and BLAST sequence identity of 56.2
  misc_feature: Encodes the peptide sequence at SEQ ID No. 174
atggcaatatcttcactctcattgagttgggcttccactaccttatcccaaaagttaagtgtccctggttcaaatgaaatattgcctagagtagcagcattttctggcaataactctgtaacatgcacggcagaggcaaccttcaatgaagaaagcaattgcaagagacgtctgctactgctaggagttggagcactaacgacaagtttagtcccagcaaatttcctttttgctgaagagataccaaagaactacacatcttttgtggactttgaagatgggtattcatattattacccctcagactggattgattttgacttcaggggacatgattctgcatttaaggacagaacgaagcaattgcagaatgttagggtgagatttataccaaccgagaaaaaagacattcatgaattgggtccaatggaagagtatgacagtcacatgcagcaagaaattatgaacgtgaaactttcaaattttcttgaaaaccagaaaaccgtagagggaaaaaactactacaccttcgagtacgaacttacatctccaaactactcaagtgtttcatttgcaaccatagttattgccaatgggagattttacactctgatagttggcgcaaatgaaagacggtggagaagatatcgcagtcagctaaaagtggtagcagactctttcaaggtgcttgacatctaa

SEQ ID NO: 174 - protein, 232 aa, Populus balsamifera subsp. trichocarpa
  misc_feature (1)..(232): Ceres ANNOT ID no. 1464944
  misc_feature (53)..(230): Pfam Name: PsbP Pfam Description: PsbP
  misc_feature (1)..(232): Functional Homolog of  Ceres CLONE ID no. 16403 at SEQ ID NO. 171 with e-value of 4.39E-60 and BLAST sequence identity of 56.2
MAISSLSLSWASTTLSQKLSVPGSNEILPRVAAFSGNNSVTCTAEATFNEESNCKRRLLLLGVGALTTSLVPANFLFAEEIPKNYTSFVDFEDGYSYYYPSDWIDFDFRGHDSAFKDRTKQLQNVRVRFIPTEKKDIHELGPMEEYDSHMQQEIMNVKLSNFLENQKTVEGKNYYTFEYELTSPNYSSVSFATIVIANGRFYTLIVGANERRWRRYRSQLKVVADSFKVLDI

SEQ ID NO: 175 - DNA, 954 bp, Arabidopsis thaliana
  misc_feature (1)..(954): Ceres CLONE ID no. 19244
  misc_feature (1)..(954): Ceres SEED LINE: ME00913
  misc_feature (507)..(507): n is a, c, t, g, unknown, or other
  misc_feature: Encodes the peptide sequence given in SEQ ID no. 176
acattacgaaaagtactagtttattggtgttattcatcgctgctcaaggtggcaaaccaaggagaacaagaagagtccagggccaatgagcctgagggtatcaaatcagtgattgatgacatctacaattttgaagacgaccctgtggttgatagattcaatagatttggaacggagatgtctgccatggtctcggccttgacacaggtggtttctgctcgctctcagactgaagctgaaggtgctcactcttcttcctcctcggctggacataagagagaatggcttggaatcgattctgttcctattccctcatcatttgctcgtgtagactcttcacataatccgatcgaagaatccataagaaaggcatttccagaggaagcaagggagaaaaaaaggaggtacagaggagtaaggcagagaccatggggcaaatgggcagctgagatacgtgatccacatagagccgctagggtttggctcgggacgtttgatacagcggangccgcggctagagcctacgacgaggctgcactccggttccgtggaaataaagcaaagctaaatttcccagaggatgtaaggattcttcctcctccccctcctcttcttcgttcaccagctgacacggtggcgaataaagcagaagaggatctgataaattattggagttatacaaagttgttgcaaagttcaggccaacggtcatttctcgagcgaggacaagaagagagtaataacatatttgaacattcaccaatggaacaacctctgcctccttcaagttctggtccaagttcctctaattttcctgcaccttctctacctaatacatagtttcacttttattaaagctctacaaatacaattaaatacatagctaaatgaaaatgattttcttgtctgtataccttcttaagtgctaaacaatatattgtactctttgtttcc

SEQ ID NO: 176 - protein, 220 aa, Arabidopsis thaliana
  misc_feature (1)..(220): Ceres CLONE ID no. 19244
  misc_feature (75)..(138): Pfam Name: AP2 Pfam Description: AP2 domain
  misc_feature (1)..(220): Ceres SEED LINE: ME00913
  misc_feature (110)..(110): Xaa is any aa, unknown, or other
MSAMVSALTQVVSARSQTEAEGAHSSSSSAGHKREWLGIDSVPIPSSFARVDSSHNPIEESIRKAFPEEAREKKRRYRGVRQRPWGKWAAEIRDPHRAARVWLGTFDTAXAAARAYDEAALRFRGNKAKLNFPEDVRILPPPPPLLRSPADTVANKAEEDLINYWSYTKLLQSSGQRSFLERGQEESNNIFEHSPMEQPLPPSSSGPSSSNFPAPSLPNT

SEQ ID NO: 177 - DNA, 1661 bp, Arabidopsis thaliana
  misc_feature (1)..(1661): Ceres CLONE ID no. 28635
  misc_feature (1)..(1661): Ceres SEED LINE: ME00147
  misc_feature: Encodes the peptide sequence given in SEQ ID no. 178
gttttcatcgatgaataaattaacaaacaaaactaaaaaataggatattcgctggccgaatcgcgtcgatccacatcgcaggtgagggttcctgcaatttatccctcgtggtctctgaatctcagatcgtcgtcaacgaatccaccattttctgaatcaaaattttctggaaacaatggggagcttggggacgatgctgagatatcccgatgatatatatccgctcctgaagatgaaacgagcgattgagaaagcggagaagcagatccctcctgagccacactggggtttctgctattcgatgctccacaaggtttctcgaagcttttctctcgttattcagcaactcaacaccgagctccgtaacgccgtgtgtgtgttctacttggttctccgagctcttgatactgttgaggatgatactagcataccaactgatgaaaaggttcccatcctgatagcttttcaccggcacatatacgatactgattggcattattcatgtggtacgaaggagtacaagattctaatggaccaatttcaccatgtttctgcagcttttttggaacttgaaaaagggtatcaagaggctatcgaggaaattactagaagaatgggtgcagggatggccaagtttatctgccaagaggtagaaactgttgatgactacgatgaatactgccactatgttgctgggcttgttggtttaggtttgtcgaaactcttcctcgctgcaggatcagaggttttgacaccagattgggaggcgatttccaattcaatgggtttatttctacagaaaacaaacattatcagagattatcttgaggacattaatgagataccaaaatcccgcatgttttggcctcgcgagatttggggcaaatatgctgacaagcttgaggatttaaaatacgaggagaacacaaacaaatccgtacagtgcttaaatgaaatggttaccaatgcgttgatgcatattgaagattgcctgaaatacatggtttccttgcgtgatccttccatatttcggttctgtgccatccctcagatcatggcgattggaacacttgcattatgctataacaatgaacaagtattcagaggcgttgtgaaactgaggcgaggtcttactgctaaagtcattgatcgtacaaagacaatggctgatgtctatggtgctttctatgatttttcctgcatgctgaagacaaaggttgacaagaacgatccaaatgccagtaagacactaaaccgacttgaagccgttcagaaactctgcagagacgctggagttcttcaaaacagaaaatcttatgttaatgacaaaggacaaccaaacagtgtctttattataatggttgtgattctactggccatagtctttgcatatctcagagcaaactgagtgatccatgtaagcgagtctgattgtatcaccatcattcaagatgttcagagcaaatttgagtgatgaagtaatctaggttgattcttattcacgccactgaatcctaagcaagattgtttccagaacaaacagagtttaagcatggtttagtctaaaaccatggattctattttagttactaccttcgttgtctaaacgtgcatttgttcatctatttttattccttgtgtttaaagttctttctttgttt

SEQ ID NO: 178 - protein, 410 aa, Arabidopsis thaliana
  misc_feature (1)..(410): Ceres CLONE ID no. 28635
  misc_feature (44)..(333): Pfam Name: SQS_PSY Pfam Description: Squalene/phytoene synthase
  misc_feature (1)..(410): Ceres SEED LINE: ME00147
MGSLGTMLRYPDDIYPLLKMKRAIEKAEKQIPPEPHWGFCYSMLHKVSRSFSLVIQQLNTELRNAVCVFYLVLRALDTVEDDTSIPTDEKVPILIAFHRHIYDTDWHYSCGTKEYKILMDQFHHVSAAFLELEKGYQEAIEEITRRMGAGMAKFICQEVETVDDYDEYCHYVAGLVGLGLSKLFLAAGSEVLTPDWEAISNSMGLFLQKTNIIRDYLEDINEIPKSRMFWPREIWGKYADKLEDLKYEENTNKSVQCLNEMVTNALMHIEDCLKYMVSLRDPSIFRFCAIPQIMAIGTLALCYNNEQVFRGVVKLRRGLTAKVIDRTKTMADVYGAFYDFSCMLKTKVDKNDPNASKTLNRLEAVQKLCRDAGVLQNRKSYVNDKGQPNSVFIIMVVILLAIVFAYLRAN

SEQ ID NO: 179 - protein, 413 aa, Glycine max
  misc_feature (1)..(413): Public GI no. 2463569
  misc_feature (44)..(331): Pfam Name: SQS_PSY Pfam Description: Squalene/phytoene synthase
  misc_feature (1)..(413): Functional Homolog of  Ceres CLONE ID no. 28635 at SEQ ID NO. 178 with e-value of 1.80E-180 and BLAST sequence identity of 80.6
MGSLGAILKHPDDFYPLLKLKMAARNAEKQIPPEPHWAFCYTMLHKVSRSFALVIQQLGIELRNAVCIFYLVLRALDTVEDDTSIETDVKVPILIAFHRHIYDRDWHFSCGTKEYKVLMDQFHHVSTAFLELGKNYQEAIEDITKRMGAGMAKFICKEVETIDDYDEYCHYVAGLVGLGLSKLFHASGSEDLAPDDLSNSMGLFLQKTNIIRDYLEDINEIPKSRMFWPRQIWSEYVNKLEDLKYEENSVKAVQCLNDMVTNALMHPEDCLKYMAALRDPPIFRFCAIPQIMAIGTLALCYNNIEVFRGVVKMRRGLTAKVIDRTKTMADVYGAFFDFASMLEPKVDKNDPNATKTLSRLEAIQKTCRESGLLSKRKSYIVNDESGYGSTMIVILVIMVSIIFAYLSANHHNS

SEQ ID NO: 180 - DNA, 1221 bp, Populus balsamifera subsp. trichocarpa
  misc_feature (1)..(1221): Ceres ANNOT ID no. 1514021
  misc_feature (1)..(1221): Functional Homolog of  Ceres CLONE ID no. 28635 at SEQ ID NO. 178 with e-value of 6.20E-157 and BLAST sequence identity of 79.9
  misc_feature: Encodes the peptide sequence at SEQ ID No. 181
atggggagtttgggagcgatattaaaacacccagctgatttatacccactattgaagctgaaaatggctgctaaacatgctgcaaaacagatcccgtctgaacctcactgggctttctgttattccatgcttcatcgggtctctcgtagttttgctttcgttattcaacagcttggcacagaactccgtaacgctgtgtgcattttttacttggttcttcgagcccttgacactgttgaggatgatacaagcatacctacagatgtcaaagtacctattctgatagcttttcaccgccacatttatgatcgcaattggcatttctcatgtggtaccaatgactacagggttcttatggaccagttccatgatgtttcaactgcttttctagagcttgaaaaaggttaccaggaggcaattgaggatattaccaaaagaatgggtgcagggatggcaaagtttatctgcaaggaggtggaaaccattgatgactatgatgaatattgccactatgtagcaggacttgttggactgggcttgtccaagcttttccatgcctctgaattagaagatttggcttcagatagcatctccaattcaatgggattgtttcttcagaaaacaaacattattcgtgattatctggaggacataaatgagatacctatgtcacgcatgttttggcctcgcgagatttggagtaaatatgtcaacaaacttgaggacttgaaatatgaagagaactcggtcgaggcagtacagtgcttgaatgacatggttaccaattccttgatacatgtggatgattgcttgaaatacatgtctgcattgcgggaacctgctatatttcggttttgtgctatccctcaggtcatggctatcggaaccctagcaatgtgctacaacaacatcaatgtcttcagaggtgtagtgaagatgagacgaggtctcaccgctcaaatttttcatcgaacgaaaacaatggccgatgtctatggagctttctttgacttctcttgtatgctgaagtccaaggttgacaggaacgatcctaatgcaacaaaaacattgagcagtctggaagcagtacaaaaaacttgcagggaatccggggctttaaacaaaaggatggtcgatttcttgaattccccagtgtgcgtatggatgatggctggctacacaagtgcctgttctattccatggaagctgcttttcttataa

SEQ ID NO: 181 - protein, 385 aa, Populus balsamifera subsp. trichocarpa
  misc_feature (1)..(385): Ceres ANNOT ID no. 1514021
  misc_feature (23)..(310): Pfam Name: SQS_PSY Pfam Description: Squalene/phytoene synthase
  misc_feature (1)..(385): Functional Homolog of  Ceres CLONE ID no. 28635 at SEQ ID NO. 178 with e-value of 6.20E-157 and BLAST sequence identity of 79.9
MAAKHAAKQIPSEPHWAFCYSMLHRVSRSFAFVIQQLGTELRNAVCIFYLVLRALDTVEDDTSIPTDVKVPILIAFHRHIYDRNWHFSCGTNDYRVLMDQFHDVSTAFLELEKGYQEAIEDITKRMGAGMAKFICKEVETIDDYDEYCHYVAGLVGLGLSKLFHASELEDLASDSISNSMGLFLQKTNIIRDYLEDINEIPMSRMFWPREIWSKYVNKLEDLKYEENSVEAVQCLNDMVTNSLIHVDDCLKYMSALREPAIFRFCAIPQVMAIGTLAMCYNNINVFRGVVKMRRGLTAQIFHRTKTMADVYGAFFDFSCMLKSKVDRNDPNATKTLSSLEAVQKTCRESGALNKRMVDFLNSPVCVWMMAGYTSACSIPWKLLFL

SEQ ID NO: 182 - protein, 415 aa, Centella asiatica
  misc_feature (1)..(415): Public GI no. 55710094
  misc_feature (44)..(331): Pfam Name: SQS_PSY Pfam Description: Squalene/phytoene synthase
  misc_feature (1)..(415): Functional Homolog of  Ceres CLONE ID no. 28635 at SEQ ID NO. 178 with e-value of 2.49E-176 and BLAST sequence identity of 79.8
MGSLGAILKHPDDFYPLLKLKMAARHAEKQIPPEPHWAFCYSMLHKVSRSFGLVIQQLGPQLRDAVCIFYLVLRALDTVEDDTSISTEVKVPILKAFHRHIYDNNWHFSCGTKEYKILMDEFHHVSNAFLELGSGYKEAIEDITMRMGAGMAKFICKEVETIDDYDEYCHYVAGLVGLGLSKLFHASGAEDLASDSLSNSMGLFLQKTNIIRDYLEDINEIPKSRMFWPRKIWNKYVNKLEDLKYEENSVKAVQCLNDMVTNALLHVEDCLKYMSDLRDPAIFRFCAIPQIMAIGTLALCYNNLQVFRGVVKMRRGLTAKVIDRTNKMSDVYGAFYDFSCMLKTKVDNNDPNATKTLSRLEAIQKKCKESGVITPNRKSYVLENDSGYNLVLIAILFIILALVYAYLSSNLSNNR

SEQ ID NO: 183 - DNA, 1242 bp, Populus balsamifera subsp. trichocarpa
  misc_feature (1)..(1242): Ceres ANNOT ID no. 1503464
  misc_feature (1)..(1242): Functional Homolog of  Ceres CLONE ID no. 28635 at SEQ ID NO. 178 with e-value of 2.90E-166 and BLAST sequence identity of 79.7
  misc_feature: Encodes the peptide sequence at SEQ ID No. 184
atggggagtttaggagcaattttgaaacacccagttgacatatacccattgctgaagctgaaaatggcagctaagcatgctgaaaaacagatcccacgtgaacctcactgggctttctgttattctatgctccctagagtctctcgtagctttgctctcgttatccaacaacttgacacagaactccgtaacgctgtatgcgtattttatttggttcttcgagcccttgacactgttgaggatgatacaagcatacctacagatgtcaaagtgcctatcctgatagcttttcaccgccacatatatgatcatgactggcatttctcatgtggtaccaaggagtacaaggttctcatggaccagtttcataatgtttcaaatgcttttctggagcttggaaaaggttatcaggaggcaatcgaggatattaccaaaagaatgggtgcaggaatggcaaagtttatcttgaaggaggtggaaagcattgatgactatgatgaatattgccactatgtagcaggacttgttggactgggcctgtccaaactcttccatgcatctggattagaagatttggcaccagatagcatctccaattcaatgggtttgtttcttcagaaaacaaacattattcgtgattatttggaggacataaacgagatacctaagtcacgcatgttttggcctcgcgagatttggagcaaatatgtcaacaaacttgaggacttgaaatatgaagagaactcggtgaaggcagtgcagtgcttgaatgatatggttaccaatgccttgatacatatggatgattgcttgaagtacttgtctgaattgcgggatcctgctatatttcggttttgtgctattcctcagatcatggcgattggaactctagcactgtgctacaacaatgtcaatgtcttcagaggtgtagtgaagatgaggcgaggtcttaccgctcaagttattcatcaaacgaaaacaatggatgatgtctatggtgctttcttcgacttctcttgtatgctgaagttcaaggttgacaacagtgatcctaatgcaataaaaaccttgagcaggctggaagcagcacaaaaatcttgcagggaatctggggctctaaacaaaaggaaatcttacataattaggaatgagccaaaatataattctgttctgatcgtcctacttttcattatattgtctattattttcgcgtatctctctgccaacagatcgagttactag

SEQ ID NO: 184 - protein, 392 aa, Populus balsamifera subsp. trichocarpa
  misc_feature (1)..(392): Ceres ANNOT ID no. 1503464
  misc_feature (23)..(310): Pfam Name: SQS_PSY Pfam Description: Squalene/phytoene synthase
  misc_feature (1)..(392): Functional Homolog of  Ceres CLONE ID no. 28635 at SEQ ID NO. 178 with e-value of 2.90E-166 and BLAST sequence identity of 79.7
MAAKHAEKQIPREPHWAFCYSMLPRVSRSFALVIQQLDTELRNAVCVFYLVLRALDTVEDDTSIPTDVKVPILIAFHRHIYDHDWHFSCGTKEYKVLMDQFHNVSNAFLELGKGYQEAIEDITKRMGAGMAKFILKEVESIDDYDEYCHYVAGLVGLGLSKLFHASGLEDLAPDSISNSMGLFLQKTNIIRDYLEDINEIPKSRMFWPREIWSKYVNKLEDLKYEENSVKAVQCLNDMVTNALIHMDDCLKYLSELRDPAIFRFCAIPQIMAIGTLALCYNNVNVFRGVVKMRRGLTAQVIHQTKTMDDVYGAFFDFSCMLKFKVDNSDPNAIKTLSRLEAAQKSCRESGALNKRKSYIIRNEPKYNSVLIVLLFIILSIIFAYLSANRSSY

SEQ ID NO: 185 - protein, 415 aa, Panax notoginseng
  misc_feature (1)..(415): Public GI no. 75859951
  misc_feature (44)..(331): Pfam Name: SQS_PSY Pfam Description: Squalene/phytoene synthase
  misc_feature (1)..(415): Functional Homolog of  Ceres CLONE ID no. 28635 at SEQ ID NO. 178 with e-value of 2.19E-177 and BLAST sequence identity of 78.8
MGSLGAILKHPDDFYPLLKLKFAARHAEKQIPPEPHWAFCYSMLHKVSRSFGLVIQQLGPQLRDAVCIFYLVLRALDTVEDDTSIPTEVKVPILMAFHRHIYDKDWHFSCGTKEYKVLMDEFHHVSNAFLELGNGYQEAIEDITMRMGAGMAKFICKEVETIDDYDEYCHYVAGLVGLGLSKLFHASGAEDLATDSLSNSMGLFLQKTNIIRDYLEDINEIPKSRMFWPRQIWSKYVDKLEDLKYEENSAKAVRCLNDMVTNALVHAEDCLKYMSDLRDPAIFRFCAIPQIMAIGTLALCFNNTQVFRGVVKMRRGLTAKVIDRTKTMSDVYGAFFDFSCLLKSKVDNNDPNATKTLSRLEAIQKTCKESGTLSKRKSYIIESESGHNSALIAIIFIILAILYAYLSSNLLPNKQ

SEQ ID NO: 186 - protein, 413 aa, Glycyrrhiza glabra
  misc_feature (1)..(413): Public GI no. 1449163
  misc_feature (44)..(331): Pfam Name: SQS_PSY Pfam Description: Squalene/phytoene synthase
  misc_feature (1)..(413): Functional Homolog of  Ceres CLONE ID no. 28635 at SEQ ID NO. 178 with e-value of 5.19E-176 and BLAST sequence identity of 78.8
MGSLGAIVRHPDEVYPLLKLKMAARHAEKQIPAEPHWAFCYTMLLKVSRSFALVIQQLDPQLRNAVCIFYLVLRALDTVEDDTSIATDVKEPILIAFHRHIYDRDWHFSCGTKEYKVLMDQFHHVSTAFLELEKNYQAAIENITKEMGAGMAKFICNEVETVDDYDEYCHYVAGLVGLGLSKLFHASGKEDLAPDHLSNSMGLFLQKTNIIRDYLEDINEIPKSRMFWPRQIWSKYVNKLEDLKYEENSVKAVQCLNDMVTNALLHAEDCLKYMSALRDMSIFRFCAIPQIMAIGTLALCYNNIEVFRGVVKMRRGLTAKVIDRTKTMADVYGAFFDFSCMLKSKVDKNDPNATKTLSRLEAIQKTCRESGLLSKRKPYILRNESTNSSTMVLILVIILSIIFAYLSAKRQDN

SEQ ID NO: 187 - protein, 412 aa, Glycyrrhiza glabra
  misc_feature (1)..(412): Public GI no. 1449165
  misc_feature (44)..(331): Pfam Name: SQS_PSY Pfam Description: Squalene/phytoene synthase
  misc_feature (1)..(412): Functional Homolog of  Ceres CLONE ID no. 28635 at SEQ ID NO. 178 with e-value of 3.69E-175 and BLAST sequence identity of 78.1
MGSLGAILKHPDDLYPLLKLKIAARQAEKQIPREPHWSFCYTMLHKVSRSFAFVIQQLGPDLRNAVCIFYLVLRALDTVEDDTSIATDVKVPILIAFHRHIYDCDWHFSCGTKEYKVLMDQFHHVSTAFLELGKNYQEAIEDITKRMGAGMAEFICKEVETVDDYDEYCHYVAGLVGMGLSKLFHASGSEDLASDYLSNSMGLFLQKTNIIRDYLEDINEIPKSRMFWPRQIWSKYVNKLEDLKYEENSVKAVQCLNDMVTNALMHAEDCLKYMAALRDLAIFRFCAIPQIMAIGTLALCYNNIELFRGVVKMRRGLTAKVIDRTKTMGDVYGAFFDFASMLESKVDKNDPNATKTLSRLEAIQKTCRESGLLNKRKSLLRNGNGYGSTMILILVILFGIMFAYLSANHHNN

SEQ ID NO: 188 - protein, 413 aa, Lotus japonicus
  misc_feature (1)..(413): Public GI no. 28208268
  misc_feature (44)..(331): Pfam Name: SQS_PSY Pfam Description: Squalene/phytoene synthase
  misc_feature (1)..(413): Functional Homolog of  Ceres CLONE ID no. 28635 at SEQ ID NO. 178 with e-value of 1.60E-172 and BLAST sequence identity of 78.1
MGSLGAIVKHPDDLYPLLKLKMAARHAEKQIPSEPHWGFCYSMLHKVSRSFALVIQQLDTDLRNAVCIFYLVLRALDTVEDDTSIATEVKVPILKAFHRHIYDRDWHFSCGTKEYKVLMGQFHLVSTAFLELAKNYQEAIEDITDRMGAGMAKFICKEVETIDDYDEYCHYVAGLVGLGLSKLFHASGKENLAADSLSNSMGLFLQKTNIIRDYLEDINEIPKSRMFWPRQIWSKYVNKLEDLKYEENSVKAVQCLNDMVTNALMHAEDCLKYMSDLRDDSIFRFCAIPQIMAIGTLAICYNNVEVFRGVVKMRRGLTAKVIDRTKTIADVYGAFFDFASMLESKVDKNDPNATKTLSRLVAIQKTCRESGLLNKRKSYILRKENGYGSTLIIILVLLFSIMFAYSSATRHSN

SEQ ID NO: 189 - protein, 415 aa, Panax ginseng
  misc_feature (1)..(415): Public GI no. 41224629
  misc_feature (44)..(331): Pfam Name: SQS_PSY Pfam Description: Squalene/phytoene synthase
  misc_feature (1)..(415): Functional Homolog of  Ceres CLONE ID no. 28635 at SEQ ID NO. 178 with e-value of 3.69E-175 and BLAST sequence identity of 77.8
MGSLGAILKHPEDFYPLLKLKFAARHAEKQIPPEPHWAFCYSMLHKVSRSFGLVIQQLGPQLRDAVCIFYLVLRALDTVEDDTSIPTEVKVPILMAFHRHIYDKDWHFSCGTKEYKVLMDEFHHVSNAFLELGSGYQEAIEDITMRMGAGMAKFICKEVETINDYDEYCHYVAGLVGLGLSKLFHASGAEDLATDSLSNSMGLFLQKTNIIRDYLEDINEIPKSRMFWPRQIWSKYVDKLEDLKYEENSAKAVQCLNDMVTDALVHAEDCLKYMSDLRGPAIFRFCAIPQIMAIGTLALCFNNTQVFRGVVKMRRGLTAKVIDQTKTMSDVYGAFFDFSCLLKSKVDNNDPNATKTLSRLEAIQKTCKESGTLSKRKSYIIESESGHNSALIAIIFIILAILYAYLSSNLLLNKQ

SEQ ID NO: 190 - protein, 413 aa, Medicago truncatula
  misc_feature (1)..(413): Public GI no. 27475614
  misc_feature (44)..(331): Pfam Name: SQS_PSY Pfam Description: Squalene/phytoene synthase
  misc_feature (1)..(413): Functional Homolog of  Ceres CLONE ID no. 28635 at SEQ ID NO. 178 with e-value of 2.10E-172 and BLAST sequence identity of 77.8
MGSIKAILKNPDDFFPLLKLKIAARNAEKQIPPEPHWGFCYSMLHKVSRSFGLVIQQLGPELRDAVCIFYLVLRALDTVEDDTSIETDVKVPILIDFHRHIYDNDWHFGCGTKEYKVLMDQFHHVSKAFLELGKNYQDAIEDITKRMGAGMAKFICKEVETVDDYDEYCHYVAGLVGLGLSKLFYASGKEDLATDKLSNSMGLFLQKTNIIRDYLEDINEIPKSRMFWPRQIWSKYVSKLEDLKYEENSVKAVQCLNDMVTNALLHADDCLQYMSALRDSSNFRFCAIPQVMAIGTLAMCYNNIGVFRGVVKMRRGLTAKVIDRTKTMADVYGAFFDFASVLESKVDKNDPNATKTSSRLEAIQKTCRESGLLTKRKSYVLRNESGYGSTMILLLVILFSIIFAYLSANRHNN

SEQ ID NO: 191 - protein, 413 aa, Artemisia annua
  misc_feature (1)..(413): Public GI no. 38426486
  misc_feature (43)..(330): Pfam Name: SQS_PSY Pfam Description: Squalene/phytoene synthase
  misc_feature (1)..(413): Functional Homolog of  Ceres CLONE ID no. 28635 at SEQ ID NO. 178 with e-value of 8.10E-171 and BLAST sequence identity of 77.0
SSLKAVLKHPDDFYPLLKLKMAAKKAEKQIPSQPHWAFSYSMLHKVSRSFALVIQQLNPQLRDAVCIFYLVLRALDTVEDDTSIAADIKVPILIAFHKHIYNRDWHFACGTKEYKVLMDQFHHVSTAFLELKRGYQEAIEDITMRMGAGMAKFICKEVETVDDYDEYCHYVAGLVGIGLSKLFHSSGTEILFSDSISNSMGLFLQKTNIIRDYLEDINEIPKSRMFWPREIWSKYVNKLEDLKYEENSEKAVQCLNDMVTNALIHIEDCLKYMSQLKDPAIFRFCAIPQIMAIGTLALCYNNIEVFRGVVKLRRGLTAKVIDRTKTMADVYQAFSDFSDMLKSKVDMHDPNAQTTITRLEAAQKICKDSGTLSNRKSYIVKRESSYSAALLALLFTILAILYAYLSANRPIKI

SEQ ID NO: 192 - DNA, 884 bp, Arabidopsis thaliana
  misc_feature (1)..(884): Ceres CLONE ID no. 35698
  misc_feature (1)..(884): Ceres SEED LINE: ME00072
  misc_feature: Encodes the peptide sequence given in SEQ ID no. 193
ctctctctttgtttattcgttaggtctcaaaggctctctctgtctctttctcaaaatcatctgcaggaagtgaatcgtcaaaaccgagtttggaggatctgtcttgaggagtttttttttggttgagaaatggcttcgaaacggatcttgaaagagctcaaggatctccagaaggatcctccaacttcctgcagtgctggcccagttgctgaagacatgtttcattggcaagctacaataatgggtccatccgatagtccttattcaggcggagtgtttctcgtaaccatccacttcccaccggattatcctttcaaaccaccaaaggttgcattcaggacaaaagtgttccaccctaatgtcaacagcaacggaagcatttgccttgacattttgaaagaacaatggagtcctgcactgaccatatcgaaggtttgctttcgatatgttcattgttaacggacccaaacccagatgatccattggttccagagattgctcacatgtacaaaaccgatagagcaaagtatgagtctactgcgagaagctggactcagaaatatgcaatgggatgaaagtttgtgtcctttgatccctcaaagactcggttttaatagagagaagagagaaagagagaggacttcttcacatagggatcttccatgaaataagttagattcctatgttttatcatctctttgtttgaaacctctttaatctcaaacaaaaacattccttctcctctttacccatccctatgtttcctatctttgttttctgtgcttttacaaaaaaaaattataagaacaattatttatgtaaagctgaaaactttgagcttttacctaacaaagtatgaagatgatgaaagatgattaaatggg

SEQ ID NO: 193 - protein, 109 aa, Arabidopsis thaliana
  misc_feature (1)..(109): Ceres CLONE ID no. 35698
  misc_feature (5)..(109): Pfam Name: UQ_con Pfam Description: Ubiquitin-conjugating enzyme
  misc_feature (1)..(109): Ceres SEED LINE: ME00072
MASKRILKELKDLQKDPPTSCSAGPVAEDMFHWQATIMGPSDSPYSGGVFLVTIHFPPDYPFKPPKVAFRTKVFHPNVNSNGSICLDILKEQWSPALTISKVCFRYVHC

SEQ ID NO: 194 - protein, 119 aa, Arabidopsis thaliana
  misc_feature (1)..(119): Ceres CLONE ID no. 1346445
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 1.90E-36 and BLAST sequence identity of 98.6
MFHWQATIMGPSDSPYSGGVFLVTIHFPPDYPFKPPKVAFRTKVFHPNINSNGSICLDILKEQWSPALTISKVLLSICSLLTDPNPDDPLVPEIAHMYKTDKNKYESTARTWTQKYAMG

SEQ ID NO: 195 - protein, 148 aa, Lycopersicon esculentum
  misc_feature (1)..(148): Public GI no. 441457
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 8.20E-52 and BLAST sequence identity of 98.0
MASKRILKELKDLQKDPPTSCSAGPVAEDMFHWQATIMGPADSPYSGGVFLVTIHFPPDYPFKPPKVAFRTKVFHPNINSNGSICLDILKEQWSPALTISKVLLSICSLLTDPNPDDPLVPEIAHMYKTDRSKYETTARSWTQKFAMG

SEQ ID NO: 196 - protein, 148 aa, Arabidopsis thaliana
  misc_feature (1)..(148): Public GI no. 19347859
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 3.49E-51 and BLAST sequence identity of 98.0
MASKRILKELKDLQKDPPTSCSAGPVAEDMFHWQATIMGPSDSPYSGGVFLVTIHFPPDYPFKPHKVAFRTKVFHPNINSNGSICLDILKEQWSPALTISKVLLSICSLLTDPNPDDPLVPEIAHMYKTDKNKYESTARTWTQKYAMG

SEQ ID NO: 197 - DNA, 498 bp, Populus balsamifera subsp. trichocarpa
  misc_feature (1)..(498): Ceres ANNOT ID no. 1483290
  misc_feature (1)..(498): Functional Homolog of  Ceres CLONE ID no. 35698 at SEQ ID NO. 193 with e-value of 2.80E-51 and BLAST sequence identity of 97.0
  misc_feature: Encodes the peptide sequence at SEQ ID No. 198
atgagaaggaggatcaatccggttcttgcaagtgaagaagaagaagaagagatggcatcgaaacggatcttgaaggaattgaaagatttgcaaaaggaccctcctacttcatgcagcgccggtcctgttgctgaagacatgttccattggcaagcaacaattatgggtcctccagatagcccttatgctggtggtgttttcctagttactattcattttcctccagactatccatttaagcctcccaaggtagcattcagaacaaaggtattccacccaaatataaatagcaatggaagcatttgcctggacattttgaaggagcaatggagccctgctctaaccatatccaaggtgttgctctcaatctgttctctgttgacggatcctaaccccgatgatccactggtgccggagatagctcacatgtacaagaccgacaggaacaagtatgagacaactgcaagaagctggacccagaagtatgcaatgggctaa

SEQ ID NO: 198 - protein, 165 aa, Populus balsamifera subsp. trichocarpa
  misc_feature (1)..(165): Ceres ANNOT ID no. 1483290
  misc_feature (22)..(159): Pfam Name: UQ_con Pfam Description: Ubiquitin-conjugating enzyme
  misc_feature (1)..(165): Functional Homolog of  Ceres CLONE ID no. 35698 at SEQ ID NO. 193 with e-value of 2.80E-51 and BLAST sequence identity of 97.0
MRRRINPVLASEEEEEEMASKRILKELKDLQKDPPTSCSAGPVAEDMFHWQATIMGPPDSPYAGGVFLVTIHFPPDYPFKPPKVAFRTKVFHPNINSNGSICLDILKEQWSPALTISKVLLSICSLLTDPNPDDPLVPEIAHMYKTDRNKYETTARSWTQKYAMG

SEQ ID NO: 199 - protein, 148 aa, Capsicum annuum
  misc_feature (1)..(148): Public GI no. 40287554
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 1.29E-51 and BLAST sequence identity of 97.0
MASKRILKELKDLQKDPPTSCSAGPVAEDMFHWQATLMGPSDSPYAGGVFLVTIHFPPDYPFKPPKVAFRTKVFHPNINSNGSICLDILKEQWSPALTISKVLLSICSLLTDPNPDDPLVPEIAHMYKTDKSKYEATARSWTQKYAMG

SEQ ID NO: 200 - protein, 148 aa, Arabidopsis thaliana
  misc_feature (1)..(148): Public GI no. 21553796
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 2.20E-51 and BLAST sequence identity of 97.0
MASKRILKELKDLQKDPPTSCSAGPVAEDMFHWQATIMGPAESPYSGGVFLVTIHFPPDYPFKPPKVAFRTKVFHPNINSNGSICLDILKEQWSPALTISKVLLSICSLLTDPNPDDPLVPEIAHMYKTDRAKYKATARNWTQKYAMG

SEQ ID NO: 201 - protein, 148 aa, Gossypium thurberi
  misc_feature (1)..(148): Public GI no. 28569271
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 2.20E-51 and BLAST sequence identity of 97.0
MASKRILKELKDLQKDPPTSCSAGPVAEDMFHWQATIMGPSDSPYAGGVFLVSIHFPPDYPFKPPKVAFRTKVFHPNINSNGSICLDILKEQWSPALTISKVLLSICSLLTDPNPDDPLVPEIAHMYKTDRAKYEATARGWTQKYAMG

SEQ ID NO: 202 - protein, 148 aa, Gossypium hirsutum
  misc_feature (1)..(148): Public GI no. 28569265
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 2.20E-51 and BLAST sequence identity of 97.0
MASKRILKELKDLQKDPPTSCSAGPVAEDMFHWQATIMGPSDSPYAGGVFLVSIHFPPDYPFKPPKVAFRTKVFHPNINSNGSICLDILKEQWSPALTISKVLLSICSLLTDPNPDDPLVLEIAHMYKTDRAKYEATARGWTQKYAMG

SEQ ID NO: 203 - protein, 148 aa, Arabidopsis thaliana
  misc_feature (1)..(148): Public GI no. 66354420
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 2.20E-51 and BLAST sequence identity of 97.0
MASKRILKELKDLQKDPPTSCSAGPVAEDMFHWQATIMGPAESPYSGGVFLVTIHFPPDYPFKPPKVAFRTKVFHPNINSNGSICLDILKEQWSPALTISKVLLSICSLLTDPNPDDPLVPEIAHMYKTDRAKYEATARNWTQKYAMG

SEQ ID NO: 204 - protein, 148 aa, Arabidopsis thaliana
  misc_feature (1)..(148): Public GI no. 21280893
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 2.20E-51 and BLAST sequence identity of 97.0
MASKRILKELKDLQKDPPTSCSAGPVAEDMFHWQATIMGPSESPYAGGVFLVTIHFPPDYPFKPPKVAFRTKVFHPNINSNGSICLDILKEQWSPALTISKVLLSICSLLTDPNPDDPLVPEIAHMYKTDKNKYESTARSWTQKYAMG

SEQ ID NO: 205 - protein, 148 aa, Arabidopsis thaliana
  misc_feature (1)..(148): Public GI no. 21554343
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 2.20E-51 and BLAST sequence identity of 97.0
MASKRILKELKDLQKDPPTSCSAGPVAEDMFHWQATIMGPSESPYAGGVFLVTIHFPPDYPFKPPKVAFRTKVFHPNINSNGSICLDILKEQWSPALTISKVLLSICSLLTDPNPDDPLVPEIAHMYKTDKNKYESTARSWTQEYAMG

SEQ ID NO: 206 - protein, 148 aa, Glycine max
  misc_feature (1)..(148): Public GI no. 22597164
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 4.50E-51 and BLAST sequence identity of 97.0
MASKRILKELKDLQKDPPTSCSAGPVAEDMFHWQATIMGPADSPYAGGVFLVTIHFPPDYPFKPPKVAFRTKVFHPNINSNGSICLDILKEQWSPALTISKGLLSICSLLTDPNPDDPLVPEIAHMYKTDRAKYEATARSWTQKYAMG

SEQ ID NO: 207 - protein, 147 aa, Triticum aestivum
  misc_feature (1)..(147): Ceres CLONE ID no. 617835
  misc_feature (5)..(142): Pfam Name: UQ_con Pfam Description: Ubiquitin-conjugating enzyme
  misc_feature (1)..(147): Functional Homolog of  Ceres CLONE ID no. 35698 at SEQ ID NO. 193 with e-value of 9.40E-51 and BLAST sequence identity of 96.0
MASKRIQKELKDLQKDPPTSCSAGPVGEDMFHWQATIMGPSDSPYSGGVFLVTIHFPPDYPFKPPKVAFRTKVFHPNINSNGSICLDILKDQWSPALTISKVLLSICSLLYDPNPDDPLVPEIAHMYKTDRHKYESTARTWTQRYAM

SEQ ID NO: 208 - protein, 149 aa, Arabidopsis thaliana
  misc_feature (1)..(149): Public GI no. 30693871
  misc_feature (5)..(143): Pfam Name: UQ_con Pfam Description: Ubiquitin-conjugating enzyme
  misc_feature (1)..(149): Functional Homolog of  Ceres CLONE ID no. 35698 at SEQ ID NO. 193 with e-value of 8.40E-50 and BLAST sequence identity of 96.0
MASKRILKELKDLQKDPPTSCIFAGPVAEDMFHWQATIMGPAESPYSGGVFLVTIHFPPDYPFKPPKVAFRTKVFHPNINSNGSICLDILKEQWSPALTISKVLLSICSLLTDPNPDDPLVPEIAHMYKTDRAKYEATARNWTQKYAMG

SEQ ID NO: 209 - protein, 148 aa, Mesembryanthemum crystallinum
  misc_feature (1)..(148): Public GI no. 5762457
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 4.50E-51 and BLAST sequence identity of 96.0
MASKRILKELKDLQKDPPTSCSAGPVGEDMFHWQATIMGPSDSPYAGGLFLVTIHFPPDYPFKPPKVAFRTKVFHPNINSNGSICLDILKEQWSPALTISKVLLSICSLLTDPNPDDPLVPEIAHMYKTDKGKYESTARSWTQKYAMG

SEQ ID NO: 210 - protein, 148 aa, Lycopersicon esculentum
  misc_feature (1)..(148): Public GI no. 464981
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 4.50E-51 and BLAST sequence identity of 96.0
MASKRILKELKDLQKDPPTSCSAGPVAEDMFHWQATIMGPTDSPYAGGVFLVSIHFPPDYPFKPPKVAFRTKVFHPNINSNGSICLDILKEQWSPALTISKVLLSICSLLTDPNPDDPLVPEIAHMYKTDRAKYETTARSWTQKYAMG

SEQ ID NO: 211 - protein, 148 aa, Pisum sativum
  misc_feature (1)..(148): Public GI no. 456568
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 4.50E-51 and BLAST sequence identity of 96.0
MASKRILKELKDLQKDPPTSCSAGPVAEDMFHWQATIVGPADSPYAGGVFLVTIHFPPDYPFKPPKVAFRTKVFHPNINSNGSICLDILKEQWSPALTISKVLLSICSLLTDPNPDDPLVPEIAHMYKTDRTKYEATARSWTQKYAMG

SEQ ID NO: 212 - protein, 148 aa, Solanum tuberosum
  misc_feature (1)..(148): Public GI no. 77416935
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 3.49E-51 and BLAST sequence identity of 96.0
MASKRILKELKDLQKDPPTSCSAGPVAEDMFHWQATLIGPSDSPYAGGVFLVTIHFPPDYPFKPPKVAFRTKVFHPNINSNGSICLDILKEQWSPALTISKVLLSICSLLTDPNPDDPLVPEIAHMYKTDKSKYEATARSWTQKYAMG

SEQ ID NO: 213 - protein, 148 aa, Gossypium arboreum
  misc_feature (1)..(148): Public GI no. 28569267
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 3.49E-51 and BLAST sequence identity of 96.0
MASKRILKELKDLQKDPPTSCSAGPVAEDMFHWQATLMGPSDSPYAGGVFLVSIHFPPDYPFKPPKVAFRTKVFHPNINSNGSICLDILKEQWSPALTISKVLLSICSLLTDPNPDDPLVPEIAHMYKTDRAKYEATARGWTQKYAMG

SEQ ID NO: 214 - protein, 148 aa, Gossypium hirsutum
  misc_feature (1)..(148): Public GI no. 28569261
  misc_feature (5)..(140): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 3.49E-51 and BLAST sequence identity of 96.0
MASKRILKELKDLQKDPPTSCSAGPVAEDMFHWQATLMGPSDSPYAGGVFLVSIHFPPDYPFKPPKVAFRTKVFHPNINSNGSICLDILKEQWSPALTISKVLLSICSLLTDPNPDDPLVPEIAHMYKTDRAKYEATACGWTQKYAMG

SEQ ID NO: 215 - protein, 119 aa, Arabidopsis thaliana
  misc_feature (1)..(119): Ceres CLONE ID no. 39130
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 9.99E-36 and BLAST sequence identity of 95.8
MFHWQATIMGPSESPYAGGVFLVTIHFPPDYPFKPPKVAFRTKVFHPNINSNGSICLDILKEQWSPALTISKVLLSICSLLTDPNPDDPLVPEIAHMYKTDKNKYESTARSWTQKYAMG

SEQ ID NO: 216 - protein, 119 aa, Arabidopsis thaliana
  misc_feature (1)..(119): Ceres CLONE ID no. 16865
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 9.99E-36 and BLAST sequence identity of 95.8
MFHWQATIMGPAESPYSGGVFLVTIHFPPDYPFKPPKVAFRTKVFHPNINSNGSICLDILKEQWSPALTISKVLLSICSLLTDPNPDDPLVPEIAHMYKTDRAKYKATARNWTQKYAMG

SEQ ID NO: 217 - protein, 119 aa, Glycine max
  misc_feature (1)..(119): Ceres CLONE ID no. 575067
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 1.30E-35 and BLAST sequence identity of 95.8
MFHWQATIMGPPDSPYAGGVFLVTIHFPPDYPFKPPKVAFRTKVFHPNINSNGSICLDILKEQWSPALTISKVLLSICSLLTDPNPDDPLVPEIAHMYKTDRNKYESTARSWTQKYAMG

SEQ ID NO: 218 - DNA, 447 bp, Populus balsamifera subsp. trichocarpa
  misc_feature (1)..(447): Ceres ANNOT ID no. 1467392
  misc_feature (1)..(447): Functional Homolog of  Ceres CLONE ID no. 35698 at SEQ ID NO. 193 with e-value of 1.30E-35 and BLAST sequence identity of 95.8
  misc_feature: Encodes the peptide sequence at SEQ ID No. 219
atggcatcgaaacggatcttgaaggaattgaaagatttacagaaggatcctcctacttcatgcagtgccggtcccgttgctgaagacatgttccattggcaagcaacaattatgggtcctccggatagtccttatgctggcggtgttttcctagttaccattcattttcctccagattatccatttaagcctcccaaggtagcattccgaacaaaggtattccacccaaatataaatagcaatggcagcatttgcctggacattttgaaggagcaatggagcccggctctaaccatatccaaggtattgctctccatctgctctttgttgacggaccctaaccccgacgatccattggtgcccgagattgctcatatgtacaagaccgacaggaacaagtatgagacgactgcaagaagctggacccagaagtatgctatgggctaa

SEQ ID NO: 219 - protein, 119 aa, Populus balsamifera subsp. trichocarpa
  misc_feature (1)..(119): Ceres ANNOT ID no. 1467392
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 1.30E-35 and BLAST sequence identity of 95.8
MFHWQATIMGPPDSPYAGGVFLVTIHFPPDYPFKPPKVAFRTKVFHPNINSNGSICLDILKEQWSPALTISKVLLSICSLLTDPNPDDPLVPEIAHMYKTDRNKYETTARSWTQKYAMG

SEQ ID NO: 220 - protein, 119 aa, Arabidopsis thaliana
  misc_feature (1)..(119): Ceres CLONE ID no. 25162
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 9.99E-36 and BLAST sequence identity of 95.8
MFHWQATIMGPSESPYAGGVFLVTIHFPPDYPFKPPKVAFRTKVFHPNINSNGSICLDILKEQWSPALTISKVLLSICSLLTDPNPDDPLVPEIAHMYKTDKNKYESTARSWTQEYAMG

SEQ ID NO: 221 - DNA, 447 bp, Populus balsamifera subsp. trichocarpa
  misc_feature (1)..(447): Ceres ANNOT ID no. 1529647
  misc_feature (1)..(447): Functional Homolog of  Ceres CLONE ID no. 35698 at SEQ ID NO. 193 with e-value of 8.20E-36 and BLAST sequence identity of 95.8
  misc_feature: Encodes the peptide sequence at SEQ ID No. 222
atggctgcaaagcgtatcttgaaggaactcaaggatttacagaaggatccacctacttcttgcagtgcaggtcctgtagctgaagatatgtttcactggcaagcaacaataatgggacctgctgatagtccatatgcaggtggggtgtttctagtaaccatccatttccctcctgattaccctttcaagcctccaaaggttgcatttaggaccaaggtctttcatcccaacattaatagtaatggaagcatttgtcttgatatcctcaaagagcagtggagtcctgctcttaccatttctaaggtactgctctccatttgctcattgctgactgatccaaatcctgatgaccctcttgtaccagagattgcccatatgtacaagactgaccgagccaaatatgaagccactgctcgcagttggacacagaagtatgccatgggctga

SEQ ID NO: 222 - protein, 119 aa, Populus balsamifera subsp. trichocarpa
  misc_feature (1)..(119): Ceres ANNOT ID no. 1529647
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 8.20E-36 and BLAST sequence identity of 95.8
MFHWQATIMGPADSPYAGGVFLVTIHFPPDYPFKPPKVAFRTKVFHPNINSNGSICLDILKEQWSPALTISKVLLSICSLLTDPNPDDPLVPEIAHMYKTDRAKYEATARSWTQKYAMG

SEQ ID NO: 223 - protein, 119 aa, Zea mays
  misc_feature (1)..(119): Ceres CLONE ID no. 1405728
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 8.20E-36 and BLAST sequence identity of 95.8
MFHWQATIMGPTDSPYAGGVFLVTIHFPPDYPFKPPKVAFRTKVFHPNINSNGSICLDILKEQWSPALTISKVLLSICSLLTDPNPDDPLVPEIAHMYKTDKNKYESTARSWTQKYAMG

SEQ ID NO: 224 - protein, 111 aa, Picea abies
  misc_feature (1)..(111): Public GI no. 54288726
  misc_feature (1)..(105): Pfam Name: UQ_con Pfam Description: Ubiquitin-conjugating enzyme
  misc_feature (1)..(111): Functional Homolog of Ceres CLONE ID no. 35698 at SEQ ID NO. 193 with e-value of 9.99E-31 and BLAST sequence identity of 95.3
MGPSDSPYAGGVFLVTIHFPPDYPFKPPKVAFRTKVFHPNINNNGSICLDILKEQWSPALTISKVLLSICSLLTDPNPDDPLVPEIAHMYKTDRGKYESTARSWTQKYAMG

SEQ ID NO: 225 - protein, 148 aa, Oryza sativa subsp. japonica
  misc_feature (1)..(148): Public GI no. 50906823
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 1.20E-50 and BLAST sequence identity of 95.0
MASKRILKELKDLQKDPPTSCSAGPVAEDMFHWQATLMGPSDSPYAGGVFLVTIHFPPDYPFKPPKVALKTKVFHPNINSNGSICLDILKEQWSPALTISKVLLSICSLLTDPNPDDPLVPEIAHMYKTDRAKYESTARSWTQKYAMG

SEQ ID NO: 226 - protein, 147 aa, Oryza sativa subsp. indica
  misc_feature (1)..(147): Public GI no. 83306206
  misc_feature (5)..(142): Pfam Name: UQ_con Pfam Description: Ubiquitin-conjugating enzyme
  misc_feature (1)..(147): Functional Homolog of  Ceres CLONE ID no. 35698 at SEQ ID NO. 193 with e-value of 3.19E-50 and BLAST sequence identity of 95.0
MASKRIQKELKDLQKDPPTSCSAGPVGEDMFHWQATIMGPSDSPYRGGVFLVTIHFPPDYPFKPPKVAFRTKVFHPNINSNGSICLDILKDQWSPALTISKVLLSICSLLTDPNPDDPLVPEIAHMYKTDRHKYENTARTWTQRYAM

SEQ ID NO: 227 - protein, 147 aa, Oryza sativa subsp. japonica
  misc_feature (1)..(147): Public GI no. 20152203
  misc_feature (5)..(142): Pfam Name: UQ_con Pfam Description: Ubiquitin-conjugating enzyme
  misc_feature (1)..(147): Functional Homolog of  Ceres CLONE ID no. 35698 at SEQ ID NO. 193 with e-value of 1.89E-50 and BLAST sequence identity of 95.0
MASKRIQKELKDLQKDPPTSCSAGPVGEDMFHWQATIMGPSDSPYAGGVFLVTIHFPPDYPFKPPKVAFRTKVFHPNINSNGSICLDILKDQWSPALTISKVLLSICSLLTDPNPDDPLVPEIAHMYKTDRHKYENTARTWTQRYAM

SEQ ID NO: 228 - protein, 119 aa, Capsicum annuum
  misc_feature (1)..(119): Public GI no. 40287568
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 2.20E-35 and BLAST sequence identity of 94.5
MFHWQATIMGPTDSPYAGGVFLVSIHFPPDYPFKPPKVAFRTKVFHPNINSNGSICLDILKEQWSPALTISKVLLSICSLLTDPNPDDPLVPEIAHMYKTDRAKYETTARSWTQKYAMG

SEQ ID NO: 229 - protein, 148 aa, Oryza sativa subsp. japonica
  misc_feature (1)..(148): Public GI no. 50929483
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 4.00E-50 and BLAST sequence identity of 94.1
MASKRILKELKDLQKDPPTSCSAGPVGEDMFHWQATIMGPSDSPFAGGVFLVNIHFPPDYPFKPPKVSFRTKVFHPNINSNGSICLDILKEQWSPALTISKVLLSICSLLTDPNPDDPLVPEIAHMYKTDRAKYESTARSWTQKYAMG

SEQ ID NO: 230 - DNA, 447 bp, Populus balsamifera subsp. trichocarpa
  misc_feature (1)..(447): Ceres ANNOT ID no. 1450556
  misc_feature (1)..(447): Functional Homolog of  Ceres CLONE ID no. 35698 at SEQ ID NO. 193 with e-value of 4.50E-35 and BLAST sequence identity of 93.1
  misc_feature: Encodes the peptide sequence at SEQ ID No. 231
atggcatcgaaaagaatattgaaggagctcaaggacttgcagagagatcccccaacttcatgcagtgcaggtcctgtggctgaggatatgttccattggcaagccaccatcataggtccaaatgacagtccctatgccggtggtgttttccttgttaccattcatttcccaccggattatccttttaaacctcccaaggttgccttcaggaccaaggtattccatccaaacataaacagtaacgggaacatctgcttggacatactcaaggaacaatggagccctgcgctcaccatatcaaaggttttactctccatatgctcactgcttacagatccaaaccctgatgatcctcttgttcctgaaatagcccatatgtgcaaggccgacaagatcaagtatgagtcttctgctaggagctggactcaaaagtatgccatgggatag

SEQ ID NO: 231 - protein, 119 aa, Populus balsamifera subsp. trichocarpa
  misc_feature (1)..(119): Ceres ANNOT ID no. 1450556
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 4.50E-35 and BLAST sequence identity of 93.1
MFHWQATIIGPNDSPYAGGVFLVTIHFPPDYPFKPPKVAFRTKVFHPNINSNGNICLDILKEQWSPALTISKVLLSICSLLTDPNPDDPLVPEIAHMCKADKIKYESSARSWTQKYAMG

SEQ ID NO: 232 - protein, 148 aa, Triticum aestivum
  misc_feature (1)..(148): Ceres CLONE ID no. 1031152
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 8.40E-50 and BLAST sequence identity of 93.1
MASKRILKELKDLQKDPPTSCSAGPVGEDMFHWQATIMGPSDSPFTGGLFLVNIHFPPDYPFKPPKVSFRTKVFHPNINSNGSICLDILKEQWSPALTISKVLLSICSLLTDPNPDDPLVPEIAHMYKTDRAKYESTARSWTQKYAMG

SEQ ID NO: 233 - protein, 148 aa, Triticum aestivum; identical to SEQ ID NO: 232
  misc_feature (1)..(148): Public GI no. 52548244
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 8.40E-50 and BLAST sequence identity of 93.1

SEQ ID NO: 234 - protein, 118 aa, Solanum tuberosum
  misc_feature (1)..(118): Public GI no. 82621144
  misc_feature (1)..(112): Pfam Name: UQ_con Pfam Description: Ubiquitin-conjugating enzyme
  misc_feature (1)..(118): Functional Homolog of  Ceres CLONE ID no. 35698 at SEQ ID NO. 193 with e-value of 7.60E-33 and BLAST sequence identity of 92.8
MSWHATIMGPTDSPYAGGVFLVSIHFPPDYPFKPPKVAFRTKVFHPNINSNGSICLDILKEQWSPALTISKVLLSICSLLTDPNPDDPLVPEIAHMYKTDRAKYETTARSWTQKYAMG

SEQ ID NO: 235 - protein, 148 aa, Triticum aestivum
  misc_feature (1)..(148): Ceres CLONE ID no. 878043
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 2.80E-49 and BLAST sequence identity of 92.1
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRSKYETTARSWTQKYAMG

SEQ ID NO: 236 - protein, 148 aa, Oryza sativa subsp. japonica
  misc_feature (1)..(148): Public GI no. 34909292
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 2.80E-49 and BLAST sequence identity of 92.1
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYETTARSWTQKYAMG

SEQ ID NO: 237 - protein, 148 aa, Zea mays
  misc_feature (1)..(148): Public GI no. 2668744
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 2.80E-49 and BLAST sequence identity of 92.1
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYESTARSWTQKYAMG

SEQ ID NO: 238 - protein, 119 aa, Glycine max
  misc_feature (1)..(119): Ceres CLONE ID no. 511132
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 9.40E-35 and BLAST sequence identity of 91.7
MFYWQATIMGPSDSPYAGGVFLVTIHFPPDYPFKPPKVAFKTKVYHPNINSNGSICLDILKEQWSPALTVSKVLLSICSLLTDPNPDDPLVPEIAHLYKTDRVKYESTARSWTQKYAMG

SEQ ID NO: 239 - DNA, 447 bp, Populus balsamifera subsp. trichocarpa
  misc_feature (1)..(447): Ceres ANNOT ID no. 1533930
  misc_feature (1)..(447): Functional Homolog of  Ceres CLONE ID no. 35698 at SEQ ID NO. 193 with e-value of 1.19E-34 and BLAST sequence identity of 91.7
  misc_feature: Encodes the peptide sequence at SEQ ID No. 240
atggcttccaagaggattaacaaggagttgaaagacctgcagaaggaccctcctgcttcatgcagtgctggtcctgttgctgatgatatgttccactggcaagcaacaattatgggcccagctgacagcccatttactggtggtgtattccttgtgtccattcactttcctccagattacccattcaagccacccaaggtctccttccgtacaaaggttttccaccctaacatcaacagcaatggaagcatttgtcttgacattctcaaagagcagtggagccctgcccttacaatatccaaggttcttctgtctatctgctcactgctgactgatccaaacccggatgatcccctggtgcctgaaattgctcacatgtacaagacagacagagccaggtatgaaactactgcacggtcctggacccagaaatatgccatgggctag

SEQ ID NO: 240 - protein, 119 aa, Populus balsamifera subsp. trichocarpa
  misc_feature (1)..(119): Ceres ANNOT ID no. 1533930
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 1.19E-34 and BLAST sequence identity of 91.7
MFHWQATIMGPADSPFTGGVFLVSIHFPPDYPFKPPKVSFRTKVFHPNINSNGSICLDILKEQWSPALTISKVLLSICSLLTDPNPDDPLVPEIAHMYKTDRARYETTARSWTQKYAMG

SEQ ID NO: 241 - DNA, 408 bp, Populus balsamifera subsp. trichocarpa
  misc_feature (1)..(408): Ceres ANNOT ID no. 1495171
  misc_feature (1)..(408): Functional Homolog of  Ceres CLONE ID no. 35698 at SEQ ID NO. 193 with e-value of 9.99E-38 and BLAST sequence identity of 91.1
  misc_feature: Encodes the peptide sequence at SEQ ID No. 242
atggcttgtgacatacaacgcatgcttacaggtcctgttgctgatgatatgttccactggcaagcaacaattatgggcccagctgacagcccatttgctggtggggtgtttctcgtatccattcacttcccaccagattacccattcaagccacccaaggtctctttccgtacaaaggttttccaccccaacatcaacagcaatggaagcatttgtcttgatattctcaaagaacagtggagccctgctcttacaatatccaaggttcttctgtccatctgttcactgttgactgatccaaaccctgatgatcccctggtgcctgaaattgctcacatgtacaagacagacagattcaagtatgaaaccactgctcggtcttggacccagaaatatgccatgggctag

SEQ ID NO: 242 - protein, 135 aa, Populus balsamifera subsp. trichocarpa
  misc_feature (1)..(135): Ceres ANNOT ID no. 1495171
  misc_feature (11)..(129): Pfam Name: UQ_con Pfam Description: Ubiquitin-conjugating enzyme
  misc_feature (1)..(135): Functional Homolog of  Ceres CLONE ID no. 35698 at SEQ ID NO. 193 with e-value of 9.99E-38 and BLAST sequence identity of 91.1
MACDIQRMLTGPVADDMFHWQATIMGPADSPFAGGVFLVSIHFPPDYPFKPPKVSFRTKVFHPNINSNGSICLDILKEQWSPALTISKVLLSICSLLTDPNPDDPLVPEIAHMYKTDRFKYETTARSWTQKYAMG

SEQ ID NO: 243 - protein, 147 aa, Oryza sativa
  misc_feature (1)..(147): Public GI no. 20086317
  misc_feature (5)..(135): Pfam Name: UQ_con Pfam Description: Ubiquitin-conjugating enzyme
  misc_feature (1)..(147): Functional Homolog of  Ceres CLONE ID no. 35698 at SEQ ID NO. 193 with e-value of 3.19E-50 and BLAST sequence identity of 90.5
MASKRILKELKDLQKDPPTSCSAGPVGEDMFHWQATIMGPSDSPFAGGVFLVNIHFPPDYPFKPPKVSFRTKVFHPNINSNGSICLDILKEQWSPALTISKVLCQFCSLLTDPNPDDPLVPEIAYMYKTDRAKYDSPLVLDKKYAWA

SEQ ID NO: 244 - protein, 119 aa, Arabidopsis thaliana
  misc_feature (1)..(119): Ceres CLONE ID no. 10022
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 4.09E-34 and BLAST sequence identity of 90.4
MFQWQATIMGPADSPFAGGVFLVTIHFPPDYPFKPPKVAFRTKVYHPNINSNGSICLDILKEQWSPALTVSKVLLSICSLLTDPNPDDPLVPEIAHIYKTDRVKYESTAQSWTQKYAMG

SEQ ID NO: 245 - protein, 119 aa, Arabidopsis thaliana; identical to SEQ ID NO: 244
  misc_feature (1)..(119): Ceres CLONE ID no. 12547
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 4.09E-34 and BLAST sequence identity of 90.4

SEQ ID NO: 246 - protein, 119 aa, Arabidopsis thaliana
  misc_feature (1)..(119): Ceres CLONE ID no. 27679
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 4.09E-34 and BLAST sequence identity of 90.4
MFHWQATIMGPNESPYSGGVFLVNIHFPPDYPFKPPKVVFRTKVFHPNINSNGNICLDILKDQWSPALTISKVLLSICSLLTDPNPDDPLVPEIAHIYKTDKTKYEAMARSWTQKYALF

SEQ ID NO: 247 - protein, 148 aa, Arabidopsis thaliana
  misc_feature (1)..(148): Public GI no. 20259611
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 9.60E-49 and BLAST sequence identity of 90.1
MASKRILKELKDLQKDPPSNCSAGPVAEDMFHWQATIMGPPESPYAGGVFLVSIHFPPDYPFKPPKVSFKTKVYHPNINSNGSICLDILKEQWSPALTISKVLLSICSLLTDPNPDDPLVPEIAHMYKTDRSKYESTARSWTQKYAMG

SEQ ID NO: 248 - protein, 148 aa, Hordeum vulgare
  misc_feature (1)..(148): Public GI no. 30025160
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 5.30E-48 and BLAST sequence identity of 90.1
  misc_feature (5)..(5): Xaa is any aa, unknown, or other
  misc_feature (139)..(139): Xaa is any aa, unknown, or other
MASKXILKEFKDLQKDPPTSCSAGPSGEDMFHWQATIMGPHDSPYAGGVFLVNIHFPPDYPFKPPKVSFKTKVFHPNINSNGSICLDILKEQWSPALTISKVLLSICSLLTDPNPDDPLVPEIAHMYKTDRSKYETTAXSWTQKYAMG

SEQ ID NO: 249 - protein, 148 aa, Oryza sativa subsp. japonica
  misc_feature (1)..(148): Public GI no. 50904839
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 9.60E-49 and BLAST sequence identity of 89.2
MALRRIIKELKDLQRDPPTSCSAGPVSDDMFHWQATIMGPNDSPYSGGVFLVTIHFPPDYPFKPPKVAFKTKVFHPNINSNGNICLDILKDQWSPALTISKVLLSICSLLTDPNPDDPLVPEIAHMCKTDRLRYESTARGWTQKYAMG

SEQ ID NO: 250 - protein, 148 aa, Zea mays
  misc_feature (1)..(148): Ceres CLONE ID no. 1063753
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 8.69E-48 and BLAST sequence identity of 89.2
MASKRINKELRDLQRDPPVSCSAGPVGDDMFHWQATIMGPTDSPFSGGVFLVSIHFPPDYPFKPPKVSFRTKVYHPNVNSNGSICLDILKEQWSPALTISKVLLSICSLLTDPNPDDPLVPEIAHTYKTDRVKYESTARSWTQKYAMG

SEQ ID NO: 251 - DNA, 447 bp, Populus balsamifera subsp. trichocarpa
  misc_feature (1)..(447): Ceres ANNOT ID no. 1533218
  misc_feature (1)..(447): Functional Homolog of  Ceres CLONE ID no. 35698 at SEQ ID NO. 193 with e-value of 1.09E-33 and BLAST sequence identity of 89.0
  misc_feature: Encodes the peptide sequence at SEQ ID No. 252
atggcttcaaaacggattaacaaggaattgagggacttgcagaaggatcctcctactgcttgcagtgcaggccctgctggtagtgacatgttccattggcaagcaacaattatgggtccagcagacagcccatacgctgggggtgtgttctctgttaacatacacttccctcctgattacccattcaagccacccaaggtttcctttaagacaaaagtttatcatccaaacattaacagcaatggcagtatctgtcttgacattctcaaggagcaatggagcccagccttgacaatttcaaaggtgttgttgtcgatatgctcgctgttgacagatccaaatcccaatgatcccctggtgcctgagattgctcatatctacacgactgatagagtcaagtatgatgctactgctcgagcctggactcagaaatatgctatgagctag

SEQ ID NO: 252 - protein, 119 aa, Populus balsamifera subsp. trichocarpa
  misc_feature (1)..(119): Ceres ANNOT ID no. 1533218
  misc_feature (1)..(113): Pfam Name: UQ_con Pfam Description: Ubiquitin-conjugating enzyme
  misc_feature (1)..(119): Functional Homolog of  Ceres CLONE ID no. 35698 at SEQ ID NO. 193 with e-value of 1.09E-33 and BLAST sequence identity of 89.0
MFHWQATIMGPADSPYAGGVFSVNIHFPPDYPFKPPKVSFKTKVYHPNINSNGSICLDILKEQWSPALTISKVLLSICSLLTDPNPNDPLVPEIAHIYTTDRVKYDATARAWTQKYAMS

SEQ ID NO: 253 - protein, 118 aa, Arabidopsis thaliana
  misc_feature (1)..(118): Public GI no. 297880
  misc_feature (1)..(112): Pfam Name: UQ_con Pfam Description: Ubiquitin-conjugating enzyme
  misc_feature (1)..(118): Functional Homolog of  Ceres CLONE ID no. 35698 at SEQ ID NO. 193 with e-value of 2.89E-33 and BLAST sequence identity of 88.8
FHWQATIMGPPESPYAGGVFLVSIHFPPDYPFKPPKVSFKTKVYHPNINSNGSICLDILKEQWSPALTISKVLLSICSLLTDPNPDDPLVPEIAHMYKTDRSKYESTARSWTQKYAMG

SEQ ID NO: 254 - protein, 148 aa, Zea mays
  misc_feature (1)..(148): Ceres CLONE ID no. 1357060
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 1.09E-47 and BLAST sequence identity of 88.2
MASKRINKELRDLQRDPPVSCSAGPVGDDMFHWQATIMGPTDSPFSGGVFLVSIHFPPDYPFKPPKVSFRTKVYHPNINSNGSICLDILKEQWSPALTISKVLLSICSLLTDPNPDDPLVPEIAHTYKTDRVKYESTARSWTQKYAMG

SEQ ID NO: 255 - protein, 148 aa, Arachis hypogaea
  misc_feature (1)..(148): Public GI no. 54402104
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 2.89E-47 and BLAST sequence identity of 87.2
MASKRITKELKDLQKDPPVSCSAGPVGDDMFHWQATIMGPADSPYAGGVFLVNIHFPPDYPFKPPKVSFKTKVFHPNIYNNGSICLDILKEQWSPALTVSKVLLSICSLLTDPNPDDPLMPEIAHMYKSDRAKYENTARSWTQKYAMN

SEQ ID NO: 256 - protein, 148 aa, Oryza sativa subsp. japonica
  misc_feature (1)..(148): Public GI no. 50725323
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 1.29E-46 and BLAST sequence identity of 87.2
MASKRIQKELMDLRKDPPTSCSAGPAGEDLFHWQATIMGPSDSPYAGGVFFVNIHFPPDYPFKPPKVNFQTKVYHPNINSNGSICLDILKEQWSPALTISKVLLSISSLLTDPNPDDPLVPEIAHVYKSQRPRYEETARAWTQKYAMG

SEQ ID NO: 257 - protein, 148 aa, Zea mays
  misc_feature (1)..(148): Ceres CLONE ID no. 376667
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 9.89E-47 and BLAST sequence identity of 87.2
MANKRIQKELMDLQKDPPTSCSAGPAGEDLFHWQATIMGPSDSPYAGGVFFVNIHFPPDYPFKPPKVNFQTKVYHPNINSNGSICLDILKEQWSPALTISKVLLSISSLLTDPNPDDPLVPEIAHMYKNQRPRYEETARAWTQKYAMG

SEQ ID NO: 258 - protein, 143 aa, Zea mays
  misc_feature (1)..(143): Ceres CLONE ID no. 256705
  misc_feature (3)..(137): Pfam Name: UQ_con Pfam Description: Ubiquitin-conjugating enzyme
  misc_feature (1)..(143): Functional Homolog of  Ceres CLONE ID no. 35698 at SEQ ID NO. 193 with e-value of 1.50E-41 and BLAST sequence identity of 86.8
MAPIFADMAKKSPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRPKYEATARSWTQKYAMG

SEQ ID NO: 259 - protein, 148 aa, Arabidopsis thaliana
  misc_feature (1)..(148): Public GI no. 20259629
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 4.80E-47 and BLAST sequence identity of 86.2
MATRRILKELKELQRDPPVSCSAGPTGEDMFHWQATIMGPNESPYSGGVFLVNIHFPPDYPFKPPKVVFRTKVFHPNINSNGNICLDILKDQWSPALTISKVLLSICSLLTDPNPDDPLVPEIAHIYKTDKTKYEAMARSWTQKYALF

SEQ ID NO: 260 - protein, 148 aa, Plantago major
  misc_feature (1)..(148): Public GI no. 52851174
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 6.09E-47 and BLAST sequence identity of 86.2
MASRRILKELRELQRDPPTSCSAGPVAQDMFHWQATIIGPNDSPYAGGVFQVTIHFPTDYPFKPPKVAFRTKVFHPNINNNGNICLDILKDQWSPALTISKVLLSICSLLTDPNPDDPLVPEIAHIYKNDKPKYESMARNWTHKYAMC

SEQ ID NO: 261 - protein, 148 aa, Zea mays
  misc_feature (1)..(148): Ceres CLONE ID no. 1061097
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 1.60E-46 and BLAST sequence identity of 86.2
MASRRINSELRDLQKDPPLSCSAGPVGDDMYHWQATIMGPTDSPFTGGVFLVSIHFPPDYPFKPPKVSFRTKVYHPNVNSNGSICLDILKEQWSPALTISKVLLSISSLLTDPNPDDPLVPEIANIYKSDRTKYENTARSWTQKYAMG

SEQ ID NO: 262 - protein, 148 aa, Oryza sativa
  misc_feature (1)..(148): Public GI no. 1373001
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 4.39E-44 and BLAST sequence identity of 86.2
MASKRILFCLKCTPKDPPTSCSAGPVAEDMFHWQATIMGPPDSPYAGGVFLVSIHFPPDYRFNRPKVAFKTKVFHPNINSNGSICLDILKEQWSPALTVSKVLLSICSLLTVPNPDDPLVPEMAHMYKTDRAKYESTARGWTQKYAMG

SEQ ID NO: 263 - protein, 148 aa, Arabidopsis thaliana
  misc_feature (1)..(148): Public GI no. 66354468
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 9.89E-47 and BLAST sequence identity of 86.2
MASKRINKELRDLQRDPPVSCSAGPTGDDMFQWQATIMGPADSPFAGGVFLVTIHFPPDYPFKPPKVAFRTKVYHPNINSNGSICLDILKEQWSPALTVSKVLLSICSLLTDPNPDDPLVPEIAHIYKTDRVKYESTAQSWTQKYAMG

SEQ ID NO: 264 - protein, 148 aa, Pinus resinosa
  misc_feature (1)..(148): Public GI no. 4100646
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 2.40E-45 and BLAST sequence identity of 82.3
MAAKRITKELQDLQRDPPISCSTGPVGDDLFHWQATIMGPVDSPYAGGVFFIVIHFPPDYPFKPPKVTFKTKVYHPNVNSNGSICLDILKEQWSPALTVSKVLLSICSLLTDPNPDDPLVPEIAHIYKSQRARYEETARAWTQKYAMN

SEQ ID NO: 265 - protein, 148 aa, Zea mays
  misc_feature (1)..(148): Ceres CLONE ID no. 1380019
  misc_feature (5)..(142): Pfam Name: UQ_con Pfam Description: Ubiquitin-conjugating enzyme
  misc_feature (1)..(148): Functional Homolog of  Ceres CLONE ID no. 35698 at SEQ ID NO. 193 with e-value of 2.80E-51 and BLAST sequence identity of 98.0
  misc_feature (128)..(128): Xaa is any aa, unknown, or other
  misc_feature (129)..(129): Xaa is any aa, unknown, or other
MASKRILKELKDLHKDPPSSCSAGPVAEDMFHWQATIMGPSDSPYSGGVFLVTIHFPPDYPFKPPKVAFRTKVFHPNVNSNGSICLDILKEQWSPALTISKVLLSICSLLTDPNPDDPLVPEIAHMYXXDRAKYESTARSWTQKYAMG

SEQ ID NO: 266 - protein, 102 aa, Artificial Sequence
  misc_feature (1)..(102): Ceres CLONE ID no. 1380019_T
  misc_feature (5)..(102): Pfam Name: UQ_con Pfam Description: Ubiquitin-conjugating enzyme
  misc_feature (1)..(102): Truncated portion of Ceres CLONE ID no. 1380019
  misc_feature (1)..(102): Functional Homolog of  Ceres CLONE ID no. 35698 at SEQ ID NO. 193 with e-value of 2.80E-51 and BLAST sequence identity of 98.0
MASKRILKELKDLHKDPPSSCSAGPVAEDMFHWQATIMGPSDSPYSGGVFLVTIHFPPDYPFKPPKVAFRTKVFHPNVNSNGSICLDILKEQWSPALTISKV

SEQ ID NO: 267 - protein, 73 aa, Artificial Sequence
  misc_feature (1)..(73): Ceres CLONE ID no. 1346445_T
  misc_feature (1)..(73): Pfam Name: UQ_con Pfam Description: Ubiquitin-conjugating enzyme
  misc_feature (1)..(73): Truncated portion of Ceres CLONE ID no. 1346445
  misc_feature (1)..(73): Functional Homolog of  Ceres CLONE ID no. 35698 at SEQ ID NO. 193 with e-value of 1.90E-36 and BLAST sequence identity of 98.6
MFHWQATIMGPSDSPYSGGVFLVTIHFPPDYPFKPPKVAFRTKVFHPNINSNGSICLDILKEQWSPALTISKV

SEQ ID NO: 268 - protein, 102 aa, Artificial Sequence
  misc_feature (1)..(102): Public GI no. 441457_T
  misc_feature (5)..(102): Pfam Name: UQ_con Pfam Description: Ubiquitin-conjugating enzyme
  misc_feature (1)..(102): Truncated portion of Public GI no. 441457
  misc_feature (1)..(102): Functional Homolog of  Ceres CLONE ID no. 35698 at SEQ ID NO. 193 with e-value of 8.20E-52 and BLAST sequence identity of 98.0
MASKRILKELKDLQKDPPTSCSAGPVAEDMFHWQATIMGPADSPYSGGVFLVTIHFPPDYPFKPPKVAFRTKVFHPNINSNGSICLDILKEQWSPALTISKV

SEQ ID NO: 269 - protein, 102 aa, Artificial Sequence
  misc_feature (1)..(102): Public GI no. 19347859_T
  misc_feature (5)..(102): Pfam Name: UQ_con Pfam Description: Ubiquitin-conjugating enzyme
  misc_feature (1)..(102): Truncated portion of Public GI no. 19347859
  misc_feature (1)..(102): Functional Homolog of  Ceres CLONE ID no. 35698 at SEQ ID NO. 193 with e-value of 3.49E-51 and BLAST sequence identity of 98.0
MASKRILKELKDLQKDPPTSCSAGPVAEDMFHWQATIMGPSDSPYSGGVFLVTIHFPPDYPFKPHKVAFRTKVFHPNINSNGSICLDILKEQWSPALTISKV

SEQ ID NO: 270 - protein, 119 aa, Populus balsamifera subsp. trichocarpa
  misc_feature (1)..(119): Ceres ANNOT ID no. 1483290_T
  misc_feature (22)..(119): Pfam Name: UQ_con Pfam Description: Ubiquitin-conjugating enzyme
  misc_feature (1)..(119): Truncated portion of Ceres ANNOT ID no. 1483290
  misc_feature (1)..(119): Functional Homolog of  Ceres CLONE ID no. 35698 at SEQ ID NO. 193 with e-value of 2.80E-51 and BLAST sequence identity of 97.0
MRRRINPVLASEEEEEEMASKRILKELKDLQKDPPTSCSAGPVAEDMFHWQATIMGPPDSPYAGGVFLVTIHFPPDYPFKPPKVAFRTKVFHPNINSNGSICLDILKEQWSPALTISKV

SEQ ID NO: 271 - protein, 102 aa, Artificial Sequence
  misc_feature (1)..(102): Public GI no. 40287554_T
  misc_feature (5)..(102): Pfam Name: UQ_con Pfam Description: Ubiquitin-conjugating enzyme
  misc_feature (1)..(102): Truncated portion of Public GI no. 40287554
  misc_feature (1)..(102): Functional Homolog of  Ceres CLONE ID no. 35698 at SEQ ID NO. 193 with e-value of 1.29E-51 and BLAST sequence identity of 97.0
MASKRILKELKDLQKDPPTSCSAGPVAEDMFHWQATLMGPSDSPYAGGVFLVTIHFPPDYPFKPPKVAFRTKVFHPNINSNGSICLDILKEQWSPALTISKV

SEQ ID NO: 272 - protein, 102 aa, Artificial Sequence
  misc_feature (1)..(102): Public GI no. 21553796_T
  misc_feature (5)..(102): Pfam Name: UQ_con Pfam Description: Ubiquitin-conjugating enzyme
  misc_feature (1)..(102): Truncated portion of Public GI no. 21553796
  misc_feature (1)..(102): Functional Homolog of  Ceres CLONE ID no. 35698 at SEQ ID NO. 193 with e-value of 2.20E-51 and BLAST sequence identity of 97.0
MASKRILKELKDLQKDPPTSCSAGPVAEDMFHWQATIMGPAESPYSGGVFLVTIHFPPDYPFKPPKVAFRTKVFHPNINSNGSICLDILKEQWSPALTISKV

SEQ ID NO: 273 - protein, 102 aa, Artificial Sequence
  misc_feature (1)..(102): Public GI no. 28569271_T
  misc_feature (5)..(102): Pfam Name: UQ_con Pfam Description: Ubiquitin-conjugating enzyme
  misc_feature (1)..(102): Truncated portion of Public GI no. 28569271
  misc_feature (1)..(102): Functional Homolog of  Ceres CLONE ID no. 35698 at SEQ ID NO. 193 with e-value of 2.20E-51 and BLAST sequence identity of 97.0
MASKRILKELKDLQKDPPTSCSAGPVAEDMFHWQATIMGPSDSPYAGGVFLVSIHFPPDYPFKPPKVAFRTKVFHPNINSNGSICLDILKEQWSPALTISKV

SEQ ID NO: 274 - protein, 102 aa, Artificial Sequence; identical to SEQ ID NO: 273
  misc_feature (1)..(102): Public GI no. 28569265_T
  misc_feature (5)..(102): Pfam Name: UQ_con Pfam Description: Ubiquitin-conjugating enzyme
  misc_feature (1)..(102): Truncated portion of Public GI no. 28569265
  misc_feature (1)..(102): Functional Homolog of  Ceres CLONE ID no. 35698 at SEQ ID NO. 193 with e-value of 2.20E-51 and BLAST sequence identity of 97.0

SEQ ID NO: 275 - protein, 102 aa, Artificial Sequence; identical to SEQ ID NO: 272
  misc_feature (1)..(102): Public GI no. 66354420_T
  misc_feature (5)..(102): Pfam Name: UQ_con Pfam Description: Ubiquitin-conjugating enzyme
  misc_feature (1)..(102): Truncated portion of Public GI no. 66354420
  misc_feature (1)..(102): Functional Homolog of  Ceres CLONE ID no. 35698 at SEQ ID NO. 193 with e-value of 2.20E-51 and BLAST sequence identity of 97.0

SEQ ID NO: 276 - protein, 102 aa, Artificial Sequence
  misc_feature (1)..(102): Public GI no. 21280893_T
  misc_feature (5)..(102): Pfam Name: UQ_con Pfam Description: Ubiquitin-conjugating enzyme
  misc_feature (1)..(102): Truncated portion of Public GI no. 21280893
  misc_feature (1)..(102): Functional Homolog of  Ceres CLONE ID no. 35698 at SEQ ID NO. 193 with e-value of 2.20E-51 and BLAST sequence identity of 97.0
MASKRILKELKDLQKDPPTSCSAGPVAEDMFHWQATIMGPSESPYAGGVFLVTIHFPPDYPFKPPKVAFRTKVFHPNINSNGSICLDILKEQWSPALTISKV

SEQ ID NO: 277 - protein, 102 aa, Artificial Sequence; identical to SEQ ID NO: 276
  misc_feature (1)..(102): Public GI no. 21554343_T
  misc_feature (5)..(102): Pfam Name: UQ_con Pfam Description: Ubiquitin-conjugating enzyme
  misc_feature (1)..(102): Truncated portion of Public GI no. 21554343
  misc_feature (1)..(102): Functional Homolog of  Ceres CLONE ID no. 35698 at SEQ ID NO. 193 with e-value of 2.20E-51 and BLAST sequence identity of 97.0

SEQ ID NO: 278 - protein, 102 aa, Artificial Sequence
  misc_feature (1)..(102): Public GI no. 22597164_T
  misc_feature (5)..(102): Pfam Name: UQ_con Pfam Description: Ubiquitin-conjugating enzyme
  misc_feature (1)..(102): Truncated portion of Public GI no. 22597164
  misc_feature (1)..(102): Functional Homolog of  Ceres CLONE ID no. 35698 at SEQ ID NO. 193 with e-value of 4.50E-51 and BLAST sequence identity of 97.0
MASKRILKELKDLQKDPPTSCSAGPVAEDMFHWQATIMGPADSPYAGGVFLVTIHFPPDYPFKPPKVAFRTKVFHPNINSNGSICLDILKEQWSPALTISKG

SEQ ID NO: 279 - protein, 102 aa, Artificial Sequence
  misc_feature (1)..(102): Ceres CLONE ID no. 617835_T
  misc_feature (5)..(102): Pfam Name: UQ_con Pfam Description: Ubiquitin-conjugating enzyme
  misc_feature (1)..(102): Truncated portion of Ceres CLONE ID no. 617835
  misc_feature (1)..(102): Functional Homolog of  Ceres CLONE ID no. 35698 at SEQ ID NO. 193 with e-value of 9.40E-51 and BLAST sequence identity of 96.0
MASKRIQKELKDLQKDPPTSCSAGPVGEDMFHWQATIMGPSDSPYSGGVFLVTIHFPPDYPFKPPKVAFRTKVFHPNINSNGSICLDILKDQWSPALTISKV

SEQ ID NO: 280 - protein, 103 aa, Artificial Sequence
  misc_feature (1)..(103): Public GI no. 30693871_T
  misc_feature (5)..(103): Pfam Name: UQ_con Pfam Description: Ubiquitin-conjugating enzyme
  misc_feature (1)..(103): Truncated portion of Public GI no. 30693871
  misc_feature (1)..(103): Functional Homolog of  Ceres CLONE ID no. 35698 at SEQ ID NO. 193 with e-value of 8.40E-50 and BLAST sequence identity of 96.0
MASKRILKELKDLQKDPPTSCIFAGPVAEDMFHWQATIMGPAESPYSGGVFLVTIHFPPDYPFKPPKVAFRTKVFHPNINSNGSICLDILKEQWSPALTISKV

SEQ ID NO: 281 - protein, 102 aa, Artificial Sequence
  misc_feature (1)..(102): Public GI no. 5762457_T
  misc_feature (5)..(102): Pfam Name: UQ_con Pfam Description: Ubiquitin-conjugating enzyme
  misc_feature (1)..(102): Truncated portion of Public GI no. 5762457
  misc_feature (1)..(102): Functional Homolog of  Ceres CLONE ID no. 35698 at SEQ ID NO. 193 with e-value of 4.50E-51 and BLAST sequence identity of 96.0
MASKRILKELKDLQKDPPTSCSAGPVGEDMFHWQATIMGPSDSPYAGGLFLVTIHFPPDYPFKPPKVAFRTKVFHPNINSNGSICLDILKEQWSPALTISKV

SEQ ID NO: 282 - protein, 102 aa, Artificial Sequence
  misc_feature (1)..(102): Public GI no. 464981_T
  misc_feature (5)..(102): Pfam Name: UQ_con Pfam Description: Ubiquitin-conjugating enzyme
  misc_feature (1)..(102): Truncated portion of Public GI no. 464981
  misc_feature (1)..(102): Functional Homolog of  Ceres CLONE ID no. 35698 at SEQ ID NO. 193 with e-value of 4.50E-51 and BLAST sequence identity of 96.0
MASKRILKELKDLQKDPPTSCSAGPVAEDMFHWQATIMGPTDSPYAGGVFLVSIHFPPDYPFKPPKVAFRTKVFHPNINSNGSICLDILKEQWSPALTISKV

SEQ ID NO: 283 - protein, 102 aa, Artificial Sequence
  misc_feature (1)..(102): Public GI no. 456568_T
  misc_feature (5)..(102): Pfam Name: UQ_con Pfam Description: Ubiquitin-conjugating enzyme
  misc_feature (1)..(102): Truncated portion of Public GI no. 456568
  misc_feature (1)..(102): Functional Homolog of  Ceres CLONE ID no. 35698 at SEQ ID NO. 193 with e-value of 4.50E-51 and BLAST sequence identity of 96.0
MASKRILKELKDLQKDPPTSCSAGPVAEDMFHWQATIVGPADSPYAGGVFLVTIHFPPDYPFKPPKVAFRTKVFHPNINSNGSICLDILKEQWSPALTISKV

SEQ ID NO: 284 - protein, 102 aa, Artificial Sequence
  misc_feature (1)..(102): Public GI no. 77416935_T
  misc_feature (5)..(102): Pfam Name: UQ_con Pfam Description: Ubiquitin-conjugating enzyme
  misc_feature (1)..(102): Truncated portion of Public GI no. 77416935
  misc_feature (1)..(102): Functional Homolog of  Ceres CLONE ID no. 35698 at SEQ ID NO. 193 with e-value of 3.49E-51 and BLAST sequence identity of 96.0
MASKRILKELKDLQKDPPTSCSAGPVAEDMFHWQATLIGPSDSPYAGGVFLVTIHFPPDYPFKPPKVAFRTKVFHPNINSNGSICLDILKEQWSPALTISKV

SEQ ID NO: 285 - protein, 102 aa, Artificial Sequence
  misc_feature (1)..(102): Public GI no. 28569267_T
  misc_feature (5)..(102): Pfam Name: UQ_con Pfam Description: Ubiquitin-conjugating enzyme
  misc_feature (1)..(102): Truncated portion of Public GI no. 28569267
  misc_feature (1)..(102): Functional Homolog of  Ceres CLONE ID no. 35698 at SEQ ID NO. 193 with e-value of 3.49E-51 and BLAST sequence identity of 96.0
MASKRILKELKDLQKDPPTSCSAGPVAEDMFHWQATLMGPSDSPYAGGVFLVSIHFPPDYPFKPPKVAFRTKVFHPNINSNGSICLDILKEQWSPALTISKV

SEQ ID NO: 286 - protein, 102 aa, Artificial Sequence; identical to SEQ ID NO: 285
  misc_feature (1)..(102): Public GI no. 28569261_T
  misc_feature (5)..(102): Pfam Name: UQ_con Pfam Description: Ubiquitin-conjugating enzyme
  misc_feature (1)..(102): Truncated portion of Public GI no. 28569261
  misc_feature (1)..(102): Functional Homolog of  Ceres CLONE ID no. 35698 at SEQ ID NO. 193 with e-value of 3.49E-51 and BLAST sequence identity of 96.0

SEQ ID NO: 287 - protein, 73 aa, Artificial Sequence
  misc_feature (1)..(73): Ceres CLONE ID no. 39130_T
  misc_feature (1)..(73): Pfam Name: UQ_con Pfam Description: Ubiquitin-conjugating enzyme
  misc_feature (1)..(73): Truncated portion of Ceres CLONE ID no. 39130
  misc_feature (1)..(73): Functional Homolog of  Ceres CLONE ID no. 35698 at SEQ ID NO. 193 with e-value of 9.99E-36 and BLAST sequence identity of 95.8
MFHWQATIMGPSESPYAGGVFLVTIHFPPDYPFKPPKVAFRTKVFHPNINSNGSICLDILKEQWSPALTISKV

SEQ ID NO: 288 - protein, 73 aa, Artificial Sequence
  misc_feature (1)..(73): Ceres CLONE ID no. 16865_T
  misc_feature (1)..(73): Pfam Name: UQ_con Pfam Description: Ubiquitin-conjugating enzyme
  misc_feature (1)..(73): Truncated portion of Ceres CLONE ID no. 16865
  misc_feature (1)..(73): Functional Homolog of  Ceres CLONE ID no. 35698 at SEQ ID NO. 193 with e-value of 9.99E-36 and BLAST sequence identity of 95.8
MFHWQATIMGPAESPYSGGVFLVTIHFPPDYPFKPPKVAFRTKVFHPNINSNGSICLDILKEQWSPALTISKV

SEQ ID NO: 289 - protein, 73 aa, Artificial Sequence
  misc_feature (1)..(73): Ceres CLONE ID no. 575067_T
  misc_feature (1)..(73): Pfam Name: UQ_con Pfam Description: Ubiquitin-conjugating enzyme
  misc_feature (1)..(73): Truncated portion of Ceres CLONE ID no. 575067
  misc_feature (1)..(73): Functional Homolog of  Ceres CLONE ID no. 35698 at SEQ ID NO. 193 with e-value of 1.30E-35 and BLAST sequence identity of 95.8
MFHWQATIMGPPDSPYAGGVFLVTIHFPPDYPFKPPKVAFRTKVFHPNINSNGSICLDILKEQWSPALTISKV

SEQ ID NO: 290 - protein, 73 aa, Populus balsamifera subsp. trichocarpa; identical to SEQ ID NO: 289
  misc_feature (1)..(73): Ceres ANNOT ID no. 1467392_T
  misc_feature (1)..(73): Pfam Name: UQ_con Pfam Description: Ubiquitin-conjugating enzyme
  misc_feature (1)..(73): Truncated portion of Ceres ANNOT ID no. 1467392
  misc_feature (1)..(73): Functional Homolog of  Ceres CLONE ID no. 35698 at SEQ ID NO. 193 with e-value of 1.30E-35 and BLAST sequence identity of 95.8

SEQ ID NO: 291 - protein, 73 aa, Artificial Sequence; identical to SEQ ID NO: 287
  misc_feature (1)..(73): Ceres CLONE ID no. 25162_T
  misc_feature (1)..(73): Pfam Name: UQ_con Pfam Description: Ubiquitin-conjugating enzyme
  misc_feature (1)..(73): Truncated portion of Ceres CLONE ID no. 25162
  misc_feature (1)..(73): Functional Homolog of  Ceres CLONE ID no. 35698 at SEQ ID NO. 193 with e-value of 9.99E-36 and BLAST sequence identity of 95.8

SEQ ID NO: 292 - protein, 73 aa, Populus balsamifera subsp. trichocarpa
  misc_feature (1)..(73): Ceres ANNOT ID no. 1529647_T
  misc_feature (1)..(73): Pfam Name: UQ_con Pfam Description: Ubiquitin-conjugating enzyme
  misc_feature (1)..(73): Truncated portion of  ANNOT ID no. 1529647
  misc_feature (1)..(73): Functional Homolog of  Ceres CLONE ID no. 35698 at SEQ ID NO. 193 with e-value of 8.20E-36 and BLAST sequence identity of 95.8
MFHWQATIMGPADSPYAGGVFLVTIHFPPDYPFKPPKVAFRTKVFHPNINSNGSICLDILKEQWSPALTISKV

SEQ ID NO: 293 - protein, 73 aa, Artificial Sequence
  misc_feature (1)..(73): Ceres CLONE ID no. 1405728_T
  misc_feature (1)..(73): Pfam Name: UQ_con Pfam Description: Ubiquitin-conjugating enzyme
  misc_feature (1)..(73): Truncated portion of Ceres CLONE ID no. 1405728
  misc_feature (1)..(73): Functional Homolog of  Ceres CLONE ID no. 35698 at SEQ ID NO. 193 with e-value of 8.20E-36 and BLAST sequence identity of 95.8
MFHWQATIMGPTDSPYAGGVFLVTIHFPPDYPFKPPKVAFRTKVFHPNINSNGSICLDILKEQWSPALTISKV

SEQ ID NO: 294 - protein, 65 aa, Artificial Sequence
  misc_feature (1)..(65): Public GI no. 54288726_T
  misc_feature (1)..(65): Pfam Name: UQ_con Pfam Description: Ubiquitin-conjugating enzyme
  misc_feature (1)..(65): Truncated portion of Public GI no. 54288726
  misc_feature (1)..(65): Functional Homolog of  Ceres CLONE ID no. 35698 at SEQ ID NO. 193 with e-value of 9.99E-31 and BLAST sequence identity of 95.3
MGPSDSPYAGGVFLVTIHFPPDYPFKPPKVAFRTKVFHPNINNNGSICLDILKEQWSPALTISKV

SEQ ID NO: 295 - protein, 102 aa, Artificial Sequence
  misc_feature (1)..(102): Public GI no. 50906823_T
  misc_feature (5)..(102): Pfam Name: UQ_con Pfam Description: Ubiquitin-conjugating enzyme
  misc_feature (1)..(102): Truncated portion of Public GI no. 50906823
  misc_feature (1)..(102): Functional Homolog of  Ceres CLONE ID no. 35698 at SEQ ID NO. 193 with e-value of 1.20E-50 and BLAST sequence identity of 95.0
MASKRILKELKDLQKDPPTSCSAGPVAEDMFHWQATLMGPSDSPYAGGVFLVTIHFPPDYPFKPPKVALKTKVFHPNINSNGSICLDILKEQWSPALTISKV

SEQ ID NO: 296 - protein, 102 aa, Artificial Sequence
  misc_feature (1)..(102): Public GI no. 83306206_T
  misc_feature (5)..(102): Pfam Name: UQ_con Pfam Description: Ubiquitin-conjugating enzyme
  misc_feature (1)..(102): Truncated portion of Public GI no. 83306206
  misc_feature (1)..(102): Functional Homolog of  Ceres CLONE ID no. 35698 at SEQ ID NO. 193 with e-value of 3.19E-50 and BLAST sequence identity of 95.0
MASKRIQKELKDLQKDPPTSCSAGPVGEDMFHWQATIMGPSDSPYRGGVFLVTIHFPPDYPFKPPKVAFRTKVFHPNINSNGSICLDILKDQWSPALTISKV

SEQ ID NO: 297 - protein, 102 aa, Artificial Sequence
  misc_feature (1)..(102): Public GI no. 20152203_T
  misc_feature (5)..(102): Pfam Name: UQ_con Pfam Description: Ubiquitin-conjugating enzyme
  misc_feature (1)..(102): Truncated portion of Public GI no. 20152203
  misc_feature (1)..(102): Functional Homolog of  Ceres CLONE ID no. 35698 at SEQ ID NO. 193 with e-value of 1.89E-50 and BLAST sequence identity of 95.0
MASKRIQKELKDLQKDPPTSCSAGPVGEDMFHWQATIMGPSDSPYAGGVFLVTIHFPPDYPFKPPKVAFRTKVFHPNINSNGSICLDILKDQWSPALTISKV

SEQ ID NO: 298 - protein, 73 aa, Artificial Sequence
  misc_feature (1)..(73): Public GI no. 40287568_T
  misc_feature (1)..(73): Pfam Name: UQ_con Pfam Description: Ubiquitin-conjugating enzyme
  misc_feature (1)..(73): Truncated portion of Public GI no. 40287568
  misc_feature (1)..(73): Functional Homolog of  Ceres CLONE ID no. 35698 at SEQ ID NO. 193 with e-value of 2.20E-35 and BLAST sequence identity of 94.5
MFHWQATIMGPTDSPYAGGVFLVSIHFPPDYPFKPPKVAFRTKVFHPNINSNGSICLDILKEQWSPALTISKV

SEQ ID NO: 299 - protein, 102 aa, Artificial Sequence
  misc_feature (1)..(102): Public GI no. 50929483_T
  misc_feature (5)..(102): Pfam Name: UQ_con Pfam Description: Ubiquitin-conjugating enzyme
  misc_feature (1)..(102): Truncated portion of Public GI no. 50929483
  misc_feature (1)..(102): Functional Homolog of  Ceres CLONE ID no. 35698 at SEQ ID NO. 193 with e-value of 4.00E-50 and BLAST sequence identity of 94.1
MASKRILKELKDLQKDPPTSCSAGPVGEDMFHWQATIMGPSDSPFAGGVFLVNIHFPPDYPFKPPKVSFRTKVFHPNINSNGSICLDILKEQWSPALTISKV

SEQ ID NO: 300 - protein, 73 aa, Populus balsamifera subsp. trichocarpa
  misc_feature (1)..(73): Ceres ANNOT ID no. 1450556_T
  misc_feature (1)..(73): Pfam Name: UQ_con Pfam Description: Ubiquitin-conjugating enzyme
  misc_feature (1)..(73): Truncated portion of  ANNOT ID no. 1450556
  misc_feature (1)..(73): Functional Homolog of  Ceres CLONE ID no. 35698 at SEQ ID NO. 193 with e-value of 4.50E-35 and BLAST sequence identity of 93.1
MFHWQATIIGPNDSPYAGGVFLVTIHFPPDYPFKPPKVAFRTKVFHPNINSNGNICLDILKEQWSPALTISKV

SEQ ID NO: 301 - protein, 148 aa, Artificial Sequence; identical to SEQ ID NO: 232
  misc_feature (1)..(148): Ceres CLONE ID no. 1031152_T
  misc_feature (5)..(142): Pfam Name: UQ_con Pfam Description: Ubiquitin-conjugating enzyme
  misc_feature (1)..(148): Truncated portion of Ceres CLONE ID no. 1031152
  misc_feature (1)..(148): Functional Homolog of  Ceres CLONE ID no. 35698 at SEQ ID NO. 193 with e-value of 8.40E-50 and BLAST sequence identity of 93.1

SEQ ID NO: 302 - protein, 102 aa, Artificial Sequence
  misc_feature (1)..(102): Public GI no. 52548244_T
  misc_feature (5)..(102): Pfam Name: UQ_con Pfam Description: Ubiquitin-conjugating enzyme
  misc_feature (1)..(102): Truncated portion of Public GI no. 52548244
  misc_feature (1)..(102): Functional Homolog of  Ceres CLONE ID no. 35698 at SEQ ID NO. 193 with e-value of 8.40E-50 and BLAST sequence identity of 93.1
MASKRILKELKDLQKDPPTSCSAGPVGEDMFHWQATIMGPSDSPFTGGLFLVNIHFPPDYPFKPPKVSFRTKVFHPNINSNGSICLDILKEQWSPALTISKV

SEQ ID NO: 303 - protein, 72 aa, Artificial Sequence
  misc_feature (1)..(72): Public GI no. 82621144_T
  misc_feature (1)..(72): Pfam Name: UQ_con Pfam Description: Ubiquitin-conjugating enzyme
  misc_feature (1)..(72): Truncated portion of Public GI no. 82621144
  misc_feature (1)..(72): Functional Homolog of  Ceres CLONE ID no. 35698 at SEQ ID NO. 193 with e-value of 7.60E-33 and BLAST sequence identity of 92.8
MSWHATIMGPTDSPYAGGVFLVSIHFPPDYPFKPPKVAFRTKVFHPNINSNGSICLDILKEQWSPALTISKV

SEQ ID NO: 304 - protein, 102 aa, Artificial Sequence
  misc_feature (1)..(102): Ceres CLONE ID no. 878043_T
  misc_feature (5)..(102): Pfam Name: UQ_con Pfam Description: Ubiquitin-conjugating enzyme
  misc_feature (1)..(102): Truncated portion of Ceres CLONE ID no. 878043
  misc_feature (1)..(102): Functional Homolog of  Ceres CLONE ID no. 35698 at SEQ ID NO. 193 with e-value of 2.80E-49 and BLAST sequence identity of 92.1
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKV

SEQ ID NO: 305 - protein, 102 aa, Artificial Sequence; identical to SEQ ID NO: 304
  misc_feature (1)..(102): Public GI no. 34909292_T
  misc_feature (5)..(102): Pfam Name: UQ_con Pfam Description: Ubiquitin-conjugating enzyme
  misc_feature (1)..(102): Truncated portion of Public GI no. 34909292
  misc_feature (1)..(102): Functional Homolog of  Ceres CLONE ID no. 35698 at SEQ ID NO. 193 with e-value of 2.80E-49 and BLAST sequence identity of 92.1

SEQ ID NO: 306 - protein, 102 aa, Artificial Sequence; identical to SEQ ID NO: 304
  misc_feature (1)..(102): Public GI no. 2668744_T
  misc_feature (5)..(102): Pfam Name: UQ_con Pfam Description: Ubiquitin-conjugating enzyme
  misc_feature (1)..(102): Truncated portion of Public GI no. 2668744
  misc_feature (1)..(102): Functional Homolog of  Ceres CLONE ID no. 35698 at SEQ ID NO. 193 with e-value of 2.80E-49 and BLAST sequence identity of 92.1

SEQ ID NO: 307 - protein, 73 aa, Artificial Sequence
  misc_feature (1)..(73): Ceres CLONE ID no. 511132_T
  misc_feature (1)..(73): Pfam Name: UQ_con Pfam Description: Ubiquitin-conjugating enzyme
  misc_feature (1)..(73): Truncated portion of Ceres CLONE ID no. 511132
  misc_feature (1)..(73): Functional Homolog of  Ceres CLONE ID no. 35698 at SEQ ID NO. 193 with e-value of 9.40E-35 and BLAST sequence identity of 91.7
MFYWQATIMGPSDSPYAGGVFLVTIHFPPDYPFKPPKVAFKTKVYHPNINSNGSICLDILKEQWSPALTVSKV

SEQ ID NO: 308 - protein, 73 aa, Artificial Sequence
  misc_feature (1)..(73): Ceres ANNOT ID no. 1533930_T
  misc_feature (1)..(73): Pfam Name: UQ_con Pfam Description: Ubiquitin-conjugating enzyme
  misc_feature (1)..(73): Truncated portion of  ANNOT ID no. 1533930
  misc_feature (1)..(73): Functional Homolog of  Ceres CLONE ID no. 35698 at SEQ ID NO. 193 with e-value of 1.19E-34 and BLAST sequence identity of 91.7
MFHWQATIMGPADSPFTGGVFLVSIHFPPDYPFKPPKVSFRTKVFHPNINSNGSICLDILKEQWSPALTISKV

SEQ ID NO: 309 - protein, 89 aa, Artificial Sequence
  misc_feature (1)..(89): Ceres ANNOT ID no. 1495171_T
  misc_feature (11)..(89): Pfam Name: UQ_con Pfam Description: Ubiquitin-conjugating enzyme
  misc_feature (1)..(89): Truncated portion of ANNOT ID no.  1495171
  misc_feature (1)..(89): Functional Homolog of  Ceres CLONE ID no. 35698 at SEQ ID NO. 193 with e-value of 9.99E-38 and BLAST sequence identity of 91.1
MACDIQRMLTGPVADDMFHWQATIMGPADSPFAGGVFLVSIHFPPDYPFKPPKVSFRTKVFHPNINSNGSICLDILKEQWSPALTISKV

SEQ ID NO: 310 - protein, 102 aa, Artificial Sequence; identical to SEQ ID NO: 299
  misc_feature (1)..(102): Public GI no. 20086317_T
  misc_feature (5)..(102): Pfam Name: UQ_con Pfam Description: Ubiquitin-conjugating enzyme
  misc_feature (1)..(102): Truncated portion of Public GI no. 20086317
  misc_feature (1)..(102): Functional Homolog of  Ceres CLONE ID no. 35698 at SEQ ID NO. 193 with e-value of 3.19E-50 and BLAST sequence identity of 90.5

SEQ ID NO: 311 - protein, 73 aa, Artificial Sequence
  misc_feature (1)..(73): Ceres CLONE ID no. 10022_T
  misc_feature (1)..(73): Pfam Name: UQ_con Pfam Description: Ubiquitin-conjugating enzyme
  misc_feature (1)..(73): Truncated portion of Ceres CLONE ID no. 10022
  misc_feature (1)..(73): Functional Homolog of  Ceres CLONE ID no. 35698 at SEQ ID NO. 193 with e-value of 4.09E-34 and BLAST sequence identity of 90.4
MFQWQATIMGPADSPFAGGVFLVTIHFPPDYPFKPPKVAFRTKVYHPNINSNGSICLDILKEQWSPALTVSKV

SEQ ID NO: 312 - protein, 73 aa, Artificial Sequence; identical to SEQ ID NO: 311
  misc_feature (1)..(73): Ceres CLONE ID no. 12547_T
  misc_feature (1)..(73): Pfam Name: UQ_con Pfam Description: Ubiquitin-conjugating enzyme
  misc_feature (1)..(73): Truncated portion of Ceres CLONE ID no. 12547
  misc_feature (1)..(73): Functional Homolog of  Ceres CLONE ID no. 35698 at SEQ ID NO. 193 with e-value of 4.09E-34 and BLAST sequence identity of 90.4

SEQ ID NO: 313 - protein, 73 aa, Artificial Sequence
  misc_feature (1)..(73): Ceres CLONE ID no. 27679_T
  misc_feature (1)..(73): Pfam Name: UQ_con Pfam Description: Ubiquitin-conjugating enzyme
  misc_feature (1)..(73): Truncated portion of Ceres CLONE ID no. 27679
  misc_feature (1)..(73): Functional Homolog of  Ceres CLONE ID no. 35698 at SEQ ID NO. 193 with e-value of 4.09E-34 and BLAST sequence identity of 90.4
MFHWQATIMGPNESPYSGGVFLVNIHFPPDYPFKPPKVVFRTKVFHPNINSNGNICLDILKDQWSPALTISKV

SEQ ID NO: 314 - protein, 102 aa, Artificial Sequence
  misc_feature (1)..(102): Public GI no. 20259611_T
  misc_feature (5)..(102): Pfam Name: UQ_con Pfam Description: Ubiquitin-conjugating enzyme
  misc_feature (1)..(102): Truncated portion of Public GI no. 20259611
  misc_feature (1)..(102): Functional Homolog of  Ceres CLONE ID no. 35698 at SEQ ID NO. 193 with e-value of 9.60E-49 and BLAST sequence identity of 90.1
MASKRILKELKDLQKDPPSNCSAGPVAEDMFHWQATIMGPPESPYAGGVFLVSIHFPPDYPFKPPKVSFKTKVYHPNINSNGSICLDILKEQWSPALTISKV

SEQ ID NO: 315 - protein, 102 aa, Artificial Sequence
  misc_feature (1)..(102): Public GI no. 30025160_T
  misc_feature (5)..(102): Pfam Name: UQ_con Pfam Description: Ubiquitin-conjugating enzyme
  misc_feature (1)..(102): Truncated portion of Public GI no. 30025160
  misc_feature (1)..(102): Functional Homolog of  Ceres CLONE ID no. 35698 at SEQ ID NO. 193 with e-value of 5.30E-48 and BLAST sequence identity of 90.1
  misc_feature (5)..(5): Xaa is any aa, unknown, or other
MASKXILKEFKDLQKDPPTSCSAGPSGEDMFHWQATIMGPHDSPYAGGVFLVNIHFPPDYPFKPPKVSFKTKVFHPNINSNGSICLDILKEQWSPALTISKV

SEQ ID NO: 316 - protein, 102 aa, Artificial Sequence
  misc_feature (1)..(102): Public GI no. 50904839_T
  misc_feature (5)..(102): Pfam Name: UQ_con Pfam Description: Ubiquitin-conjugating enzyme
  misc_feature (1)..(102): Truncated portion of Public GI no. 50904839
  misc_feature (1)..(102): Functional Homolog of  Ceres CLONE ID no. 35698 at SEQ ID NO. 193 with e-value of 9.60E-49 and BLAST sequence identity of 89.2
MALRRIIKELKDLQRDPPTSCSAGPVSDDMFHWQATIMGPNDSPYSGGVFLVTIHFPPDYPFKPPKVAFKTKVFHPNINSNGNICLDILKDQWSPALTISKV

SEQ ID NO: 317 - protein, 102 aa, Artificial Sequence
  misc_feature (1)..(102): Ceres CLONE ID no. 1063753_T
  misc_feature (5)..(102): Pfam Name: UQ_con Pfam Description: Ubiquitin-conjugating enzyme
  misc_feature (1)..(102): Truncated portion of Ceres CLONE ID no. 1063753
  misc_feature (1)..(102): Functional Homolog of  Ceres CLONE ID no. 35698 at SEQ ID NO. 193 with e-value of 8.69E-48 and BLAST sequence identity of 89.2
MASKRINKELRDLQRDPPVSCSAGPVGDDMFHWQATIMGPTDSPFSGGVFLVSIHFPPDYPFKPPKVSFRTKVYHPNVNSNGSICLDILKEQWSPALTISKV

SEQ ID NO: 318 - protein, 73 aa, Artificial Sequence
  misc_feature (1)..(73): Ceres ANNOT ID no. 1533218_T
  misc_feature (1)..(73): Pfam Name: UQ_con Pfam Description: Ubiquitin-conjugating enzyme
  misc_feature (1)..(73): Truncated portion of  ANNOT ID no.  1533218
  misc_feature (1)..(73): Functional Homolog of  Ceres CLONE ID no. 35698 at SEQ ID NO. 193 with e-value of 1.09E-33 and BLAST sequence identity of 89.0
MFHWQATIMGPADSPYAGGVFSVNIHFPPDYPFKPPKVSFKTKVYHPNINSNGSICLDILKEQWSPALTISKV

SEQ ID NO: 319 - protein, 72 aa, Artificial Sequence
  misc_feature (1)..(72): Public GI no. 297880_T
  misc_feature (1)..(72): Pfam Name: UQ_con Pfam Description: Ubiquitin-conjugating enzyme
  misc_feature (1)..(72): Truncated portion of Public GI no. 297880
  misc_feature (1)..(72): Functional Homolog of  Ceres CLONE ID no. 35698 at SEQ ID NO. 193 with e-value of 2.89E-33 and BLAST sequence identity of 88.8
FHWQATIMGPPESPYAGGVFLVSIHFPPDYPFKPPKVSFKTKVYHPNINSNGSICLDILKEQWSPALTISKV

SEQ ID NO: 320 - protein, 102 aa, Artificial Sequence
  misc_feature (1)..(102): Ceres CLONE ID no. 1357060_T
  misc_feature (5)..(102): Pfam Name: UQ_con Pfam Description: Ubiquitin-conjugating enzyme
  misc_feature (1)..(102): Truncated portion of Ceres CLONE ID no. 1357060
  misc_feature (1)..(102): Functional Homolog of  Ceres CLONE ID no. 35698 at SEQ ID NO. 193 with e-value of 1.09E-47 and BLAST sequence identity of 88.2
MASKRINKELRDLQRDPPVSCSAGPVGDDMFHWQATIMGPTDSPFSGGVFLVSIHFPPDYPFKPPKVSFRTKVYHPNINSNGSICLDILKEQWSPALTISKV

SEQ ID NO: 321 - protein, 102 aa, Artificial Sequence
  misc_feature (1)..(102): Public GI no. 54402104_T
  misc_feature (5)..(102): Pfam Name: UQ_con Pfam Description: Ubiquitin-conjugating enzyme
  misc_feature (1)..(102): Truncated portion of Public GI no. 54402104
  misc_feature (1)..(102): Functional Homolog of  Ceres CLONE ID no. 35698 at SEQ ID NO. 193 with e-value of 2.89E-47 and BLAST sequence identity of 87.2
MASKRITKELKDLQKDPPVSCSAGPVGDDMFHWQATIMGPADSPYAGGVFLVNIHFPPDYPFKPPKVSFKTKVFHPNIYNNGSICLDILKEQWSPALTVSKV

SEQ ID NO: 322 - protein, 102 aa, Artificial Sequence
  misc_feature (1)..(102): Public GI no. 50725323_T
  misc_feature (5)..(102): Pfam Name: UQ_con Pfam Description: Ubiquitin-conjugating enzyme
  misc_feature (1)..(102): Truncated portion of Public GI no. 50725323
  misc_feature (1)..(102): Functional Homolog of  Ceres CLONE ID no. 35698 at SEQ ID NO. 193 with e-value of 1.29E-46 and BLAST sequence identity of 87.2
MASKRIQKELMDLRKDPPTSCSAGPAGEDLFHWQATIMGPSDSPYAGGVFFVNIHFPPDYPFKPPKVNFQTKVYHPNINSNGSICLDILKEQWSPALTISKV

SEQ ID NO: 323 - protein, 102 aa, Artificial Sequence
  misc_feature (1)..(102): Ceres CLONE ID no. 376667_T
  misc_feature (5)..(102): Pfam Name: UQ_con Pfam Description: Ubiquitin-conjugating enzyme
  misc_feature (1)..(102): Truncated portion of Ceres CLONE ID no. 376667
  misc_feature (1)..(102): Functional Homolog of  Ceres CLONE ID no. 35698 at SEQ ID NO. 193 with e-value of 9.89E-47 and BLAST sequence identity of 87.2
MANKRIQKELMDLQKDPPTSCSAGPAGEDLFHWQATIMGPSDSPYAGGVFFVNIHFPPDYPFKPPKVNFQTKVYHPNINSNGSICLDILKEQWSPALTISKV

SEQ ID NO: 324 - protein, 97 aa, Artificial Sequence
  misc_feature (1)..(97): Ceres CLONE ID no. 256705_T
  misc_feature (5)..(97): Pfam Name: UQ_con Pfam Description: Ubiquitin-conjugating enzyme
  misc_feature (1)..(97): Truncated portion of Ceres CLONE ID no. 256705
  misc_feature (1)..(97): Functional Homolog of  Ceres CLONE ID no. 35698 at SEQ ID NO. 193 with e-value of 1.50E-41 and BLAST sequence identity of 86.8
MAPIFADMAKKSPTSCSAGPAGEDMFHWQATIMGPPDSPYAGGVFLVNIHFPPDYPFKPPKVSFKTKVFHPNINSNGSICLDILKEQWSPALTISKV

SEQ ID NO: 325 - protein, 102 aa, Artificial Sequence
  misc_feature (1)..(102): Public GI no. 20259629_T
  misc_feature (5)..(102): Pfam Name: UQ_con Pfam Description: Ubiquitin-conjugating enzyme
  misc_feature (1)..(102): Truncated portion of Public GI no. 20259629
  misc_feature (1)..(102): Functional Homolog of  Ceres CLONE ID no. 35698 at SEQ ID NO. 193 with e-value of 4.80E-47 and BLAST sequence identity of 86.2
MATRRILKELKELQRDPPVSCSAGPTGEDMFHWQATIMGPNESPYSGGVFLVNIHFPPDYPFKPPKVVFRTKVFHPNINSNGNICLDILKDQWSPALTISKV

SEQ ID NO: 326 - protein, 102 aa, Artificial Sequence
  misc_feature (1)..(102): Public GI no. 52851174_T
  misc_feature (5)..(102): Pfam Name: UQ_con Pfam Description: Ubiquitin-conjugating enzyme
  misc_feature (1)..(102): Truncated portion of Public GI no. 52851174
  misc_feature (1)..(102): Functional Homolog of  Ceres CLONE ID no. 35698 at SEQ ID NO. 193 with e-value of 6.09E-47 and BLAST sequence identity of 86.2
MASRRILKELRELQRDPPTSCSAGPVAQDMFHWQATIIGPNDSPYAGGVFQVTIHFPTDYPFKPPKVAFRTKVFHPNINNNGNICLDILKDQWSPALTISKV

SEQ ID NO: 327 - protein, 102 aa, Artificial Sequence
  misc_feature (1)..(102): Ceres CLONE ID no. 1061097_T
  misc_feature (5)..(102): Pfam Name: UQ_con Pfam Description: Ubiquitin-conjugating enzyme
  misc_feature (1)..(102): Truncated portion of Ceres CLONE ID no. 1061097
  misc_feature (1)..(102): Functional Homolog of  Ceres CLONE ID no. 35698 at SEQ ID NO. 193 with e-value of 1.60E-46 and BLAST sequence identity of 86.2
MASRRINSELRDLQKDPPLSCSAGPVGDDMYHWQATIMGPTDSPFTGGVFLVSIHFPPDYPFKPPKVSFRTKVYHPNVNSNGSICLDILKEQWSPALTISKV

SEQ ID NO: 328 - protein, 102 aa, Artificial Sequence
  misc_feature (1)..(102): Public GI no. 1373001_T
  misc_feature (5)..(102): Pfam Name: UQ_con Pfam Description: Ubiquitin-conjugating enzyme
  misc_feature (1)..(102): Truncated portion of Public GI no. 1373001
  misc_feature (1)..(102): Functional Homolog of  Ceres CLONE ID no. 35698 at SEQ ID NO. 193 with e-value of 4.39E-44 and BLAST sequence identity of 86.2
MASKRILFCLKCTPKDPPTSCSAGPVAEDMFHWQATIMGPPDSPYAGGVFLVSIHFPPDYRFNRPKVAFKTKVFHPNINSNGSICLDILKEQWSPALTVSKV

SEQ ID NO: 329 - protein, 102 aa, Artificial Sequence
  misc_feature (1)..(102): Public GI no. 66354468_T
  misc_feature (5)..(102): Pfam Name: UQ_con Pfam Description: Ubiquitin-conjugating enzyme
  misc_feature (1)..(102): Truncated portion of Public GI no. 66354468
  misc_feature (1)..(102): Functional Homolog of  Ceres CLONE ID no. 35698 at SEQ ID NO. 193 with e-value of 9.89E-47 and BLAST sequence identity of 86.2
MASKRINKELRDLQRDPPVSCSAGPTGDDMFQWQATIMGPADSPFAGGVFLVTIHFPPDYPFKPPKVAFRTKVYHPNINSNGSICLDILKEQWSPALTVSKV

SEQ ID NO: 330 - protein, 102 aa, Artificial Sequence
  misc_feature (1)..(102): Public GI no. 4100646_T
  misc_feature (5)..(102): Pfam Name: UQ_con Pfam Description: Ubiquitin-conjugating enzyme
  misc_feature (1)..(102): Truncated portion of Public GI no. 4100646
  misc_feature (1)..(102): Functional Homolog of  Ceres CLONE ID no. 35698 at SEQ ID NO. 193 with e-value of 2.40E-45 and BLAST sequence identity of 82.3
MAAKRITKELQDLQRDPPISCSTGPVGDDLFHWQATIMGPVDSPYAGGVFFIVIHFPPDYPFKPPKVTFKTKVYHPNVNSNGSICLDILKEQWSPALTVSKV

SEQ ID NO: 331 - DNA, 1213 bp, Arabidopsis thaliana
  misc_feature (1)..(1213): Ceres CLONE ID no. 36412
  misc_feature (1)..(1213): Ceres SEED LINE: ME00902
  misc_feature: Encodes the peptide sequence given in SEQ ID no. 332
atcttcttctctctaaacctctccttcaatggccgtcgatgctcaccatctctttctttctcctcctcaactcttctccaacagagaattaacgatgaataataacactatggaaccaactagtggcggtttctgcaataacaatcaaaccggttacggcgtcgtttcacctttctccgttccaaaccatacatcaacaacaacaacagcaacgcctcctcttcttcatatgtacggcggctctgatactattcccaccaccgccggttactacgccgatggtgctactaatctcgactgtgaatttttccctttaccaacgagaaaacgctcaagagattcttcaagatcaaattatcatcatcttcttcttcagaacccgagatcatcatcatgtgttaacgctgctactacaacaactacaacaactccgttctcgtttcttggccaagacattgatatctcctctcacatgaatcaacaacaacacgaaatagatcgattcgtctcccttcacttatatcagatggagagagtgaaatatgagatagaagagaagaggaaaagacaagcgagaacgataatggaggcgatagagcaaggactggttaaaaggcttcgtgtcaaagaagaagaaagagagaggatcggcaaggttaaccacgcgcttgaggagcgagtgaagtcactttctatagagaaccaaatctggagagaccttgctcagacgaacgaagccacggctaaccacctccgaaccaacctcgagcatgttctggcgcaggttaaggacgtatcacgcggcgcaggattagagaaaaacatgaacgaagaggacgatgcggagtcgtgctgcggaagcagctgtggtggtggtggtgaagaaacggtaaggcgcagggtaggattagaaagggaggcgcaggataaggcggagaggaggaggaggaggatgtgtagaaactgtggggaggaggaatcgtgtgtgttgctgttaccgtgcagacacttgtgcttgtgtggagtatgcgggtccagtgtgcacacgtgtcccatctgtacatctcctaaaaacgctagcgttcatgtcaacatgtcatcttgaccccgtcccgtttatggaatactcctcttcttctttttttwtttttttttttgttctttagaaaatttgtaaggatattttagttgaatattattattatttttagct

SEQ ID NO: 332 - protein, 358 aa, Arabidopsis thaliana
  misc_feature (1)..(358): Ceres CLONE ID no. 36412
  misc_feature (1)..(358): Ceres SEED LINE: ME00902
MAVDAHHLFLSPPQLFSNRELTMNNNTMEPTSGGFCNNNQTGYGVVSPFSVPNHTSTTTTATPPLLHMYGGSDTIPTTAGYYADGATNLDCEFFPLPTRKRSRDSSRSNYHHLLLQNPRSSSCVNAATTTTTTTPFSFLGQDIDISSHMNQQQHEIDRFVSLHLYQMERVKYEIEEKRKRQARTIMEAIEQGLVKRLRVKEEERERIGKVNHALEERVKSLSIENQIWRDLAQTNEATANHLRTNLEHVLAQVKDVSRGAGLEKNMNEEDDAESCCGSSCGGGGEETVRRRVGLEREAQDKAERRRRRMCRNCGEEESCVLLLPCRHLCLCGVCGSSVHTCPICTSPKNASVHVNMSS

SEQ ID NO: 333 - protein, 347 aa, Arabidopsis thaliana
  misc_feature (1)..(347): Public GI no. 3152583
  misc_feature (1)..(347): Functional Homolog of  Ceres CLONE ID no. 36412 at SEQ ID NO. 332 with e-value of 2.00E-176 and BLAST sequence identity of 98.5
MNNNTMEPTSGGFCNNNQTGYGVVSPFSVPNHTSTTTTATPPLLHVYGGSDTIPTTAGYYADGATNLDCEFFPLPTRKRSRDSSRSNYHHLLLQNPRSSSCVNAATTTTTTTLFSFLGQDIDISSHMNQQQHEIDRFVSLHVSFASTAEFVAMCIMERVKYEIEEKRKRQARTIMEAIEQGLVKRLRVKEEERERIGKVNHALEERVKSLSIENQIWRDLAQTNEATANHLRTNLEHVLAQVKDVSRGAGLEKNMNEEDDAESCCGSSCGGGGEETVRRRVGLEREAQDKAERRRRRMCRNCGEEESCVLLLPCRHLCLCGVCGSSVHTCPICTSPKNASVHVNMSS

SEQ ID NO: 334 - DNA, 1023 bp, Populus balsamifera subsp. trichocarpa
  misc_feature (1)..(1023): Ceres ANNOT ID no. 1467033
  misc_feature (1)..(1023): Functional Homolog of  Ceres CLONE ID no. 36412 at SEQ ID NO. 332 with e-value of 1.20E-68 and BLAST sequence identity of 60.2
  misc_feature: Encodes the peptide sequence at SEQ ID No. 335
atggctgttgaagcaaggcacctcaatctcttccctcctcaactcataagcagcagggaaataacgaaccccattgaagcaaatacaaatatgtacaacacccaaatgggatatggtgtgccattatcaggaggaactacaacgacaacagctgatacacttcttcctatgtacagttctgtgatcactgattcaatctcccataaaacaccaatcaaatcagacagtggtctcacttacaacgtccctgtacaaagaaagcgcccaagagactctatcaatcctctcctctcatatccaactctagtacaatccaataagacttgcgctcccttctcctttcttggccaagacctctcttttcagatccaacaacagcaattagacatcgattgccttgtttctcaacatatggagaaagtaaggatggagatagaagagaagaggaggaggcaagcaaggaggataatagaggcaatagagacagggatgatgaagagactaagagcaaaagaagaagaaattgaaaagataggcaaattgaattgggccctcgaagagaaagtcaagtctttgtgcgtagagaaccaaatatggagagacttggcacaatccaacgaagcaacagccaatactctacgttccaatcttgaacaagtccttgcagcacaggttaaggaagaccgcacccttggtgcaggattggatgatcagacagcagcattactggacgatgcccaatcatgttgtggtagcaatggtggtgatggtgatgatggatgggaagaaaaagtgtcggagaggtgcacgttagcaaatggggcgcaggacaataatggtgcaggtccaaggggtacaggtacaagtagttggttgtgcaggaactgtaacaaggcagagtcttgtgtgttgctgttgccttgtaggcatctgtgcttgtgtactgtttgtgggtcaagtctccatacttgccccatctgtaaagccaccaagaatgctagtgtccatgttaacttgtcatga

SEQ ID NO: 335 - protein, 310 aa, Populus balsamifera subsp. trichocarpa
  misc_feature (1)..(310): Ceres ANNOT ID no. 1467033
  misc_feature (1)..(310): Functional Homolog of  Ceres CLONE ID no. 36412 at SEQ ID NO. 332 with e-value of 1.20E-68 and BLAST sequence identity of 60.2
MYNTQMGYGVPLSGGTTTTTADTLLPMYSSVITDSISHKTPIKSDSGLTYNVPVQRKRPRDSINPLLSYPTLVQSNKTCAPFSFLGQDLSFQIQQQQLDIDCLVSQHMEKVRMEIEEKRRRQARRIIEAIETGMMKRLRAKEEEIEKIGKLNWALEEKVKSLCVENQIWRDLAQSNEATANTLRSNLEQVLAAQVKEDRTLGAGLDDQTAALLDDAQSCCGSNGGDGDDGWEEKVSERCTLANGAQDNNGAGPRGTGTSSWLCRNCNKAESCVLLLPCRHLCLCTVCGSSLHTCPICKATKNASVHVNLS

SEQ ID NO: 336 - DNA, 1014 bp, Populus balsamifera subsp. trichocarpa
  misc_feature (1)..(1014): Ceres ANNOT ID no. 1536919
  misc_feature (1)..(1014): Functional Homolog of  Ceres CLONE ID no. 36412 at SEQ ID NO. 332 with e-value of 7.90E-70 and BLAST sequence identity of 60.1
  misc_feature: Encodes the peptide sequence at SEQ ID No. 337
atggccgttgaagccaggcacctcaatctcttccctcctcaactcttaagcaacagggaaatgatgatgaaccccattgaagcagatacatatatgtacaacacccagatgggatatggtgtgccattatcaggaactacaacaacagcagagacagtgcttcctatgtatagctctgtgatcactgattcaatccctcataaaacgcaaatcaaatcagaaagtggtctcacttacaatctccctgtacagaggaagcgcccaagagacaccatcaatcctctcctctcatatccaattccagtacagtccactaagacttgcactcccttctcctttcttggccaggacctctcttttcagatccaacaacagcaattagacacagattgccttatttctcaacatatggagaaagtaaggatggagatagaagagaaaaggaagaggcaggcaagaaggttactcgaggcattagagacagggatggtgaagcgactaagagcaaaagaagaagaaatcgaaaagataggcaaattaaactgggcccttgaagagaaagtcaagtctttatgcatggagaatcaaatatggagagacctagcgcaatccaatgaagcaacagccaatgctctacgttccaatcttgaacaagtcctcgcagcccaggttaacgaagaacgcacccttggtgcaggattagataatcaggcagcagcattaatggacgatgcgcaatcatgctgtggcagcagcggtggtgatggacctgttggcgacgatggatgggaagaaagagtgtcggagagatgcacgttagccaatggggcgcaggataataaaggtacaggagcaggtagttggatgtgcaggaattgtaacaaggaagagtcatgtgtgttgctgttgccttgcaggcatctgtgcttgtgtactgtttgtgggtcaagcctccatacttgccccatctgtagagccaccaagaatgctagcgtccatgttaacttgtcatga

SEQ ID NO: 337 - protein, 316 aa, Populus balsamifera subsp. trichocarpa
  misc_feature (1)..(316): Ceres ANNOT ID no. 1536919
  misc_feature (1)..(316): Functional Homolog of  Ceres CLONE ID no. 36412 at SEQ ID NO. 332 with e-value of 7.90E-70 and BLAST sequence identity of 60.1
MMNPIEADTYMYNTQMGYGVPLSGTTTTAETVLPMYSSVITDSIPHKTQIKSESGLTYNLPVQRKRPRDTINPLLSYPIPVQSTKTCTPFSFLGQDLSFQIQQQQLDTDCLISQHMEKVRMEIEEKRKRQARRLLEALETGMVKRLRAKEEEIEKIGKLNWALEEKVKSLCMENQIWRDLAQSNEATANALRSNLEQVLAAQVNEERTLGAGLDNQAAALMDDAQSCCGSSGGDGPVGDDGWEERVSERCTLANGAQDNKGTGAGSWMCRNCNKEESCVLLLPCRHLCLCTVCGSSLHTCPICRATKNASVHVNLS

SEQ ID NO: 338 - protein, 309 aa, Glycine max
  misc_feature (1)..(309): Ceres CLONE ID no. 1641329
  misc_feature (1)..(309): Functional Homolog of  Ceres CLONE ID no. 36412 at SEQ ID NO. 332 with e-value of 1.90E-61 and BLAST sequence identity of 52.7
MMNMYNNSTPIGGYSSFLPLSGAVTETALPSSVFNHSLANAVKSESGVTYNNNNNNNNVSVSPMSRKRSRDNNNNYGYNNNNNDSFSFLGQDVSLQIQQQQLDIEHLIMQRMEKVRMEIDEKRKRQARRIIEAIEVGVMKKLKTKEEEIEKIGKLNWALEEKVKHLCMENQVWRNIAETNEATANALRCNLEQVLAQRGGMAAEEDVGGGATVCGGAEMDDAESCCGSTEEDGLEKETGGWRTLAGCAGVKDKEGGGNGRLCRNCRKEESCVLILPCRHLCLCTVCGSSLHICPICKSYKTASVHVNMS

SEQ ID NO: 339 - protein, 337 aa, Glycine max
  misc_feature (1)..(337): Ceres CLONE ID no. 1650419
  misc_feature (1)..(337): Functional Homolog of  Ceres CLONE ID no. 36412 at SEQ ID NO. 332 with e-value of 1.39E-65 and BLAST sequence identity of 52.0
MAVEARHLNLFPSQLITNRQVMDSGEANMMNMYNNSTPIGGYSSFLPLSGAVTETALPSSVFNHSLANAVKSESGVTYNNNNNNNNVSVSPMSRKRSRDNNNNYGYNNNNNDSFSFLGQDVSLQIQQQQLDIEHLIMQRMEKVRMEIDEKRKRQARRIIEAIEVGVMKKLKTKEEEIEKIGKLNWALEEKVKHLCMENQVWRNIAETNEATANALRCNLEQVLAQRGGMAAEEDVGGGATVCGGAEMDDAESCCGSTEEDGLEKETGGWRTLAGCAGVKDKEGGGNGRLCRNCRKEESCVLILPCRHLCLCTVCGSSLHICPICKSYKTASVHVNMS

SEQ ID NO: 340 - protein, 336 aa, Glycine max
  misc_feature (1)..(336): Ceres CLONE ID no. 597699
  misc_feature (1)..(336): Functional Homolog of  Ceres CLONE ID no. 36412 at SEQ ID NO. 332 with e-value of 1.09E-63 and BLAST sequence identity of 51.0
  misc_feature (172)..(172): Xaa is any aa, unknown, or other
  misc_feature (239)..(239): Xaa is any aa, unknown, or other
MAVEARHLNLFPSQLITNRQVMDSGEANMMNMYNNSTPIGGYSSFLPLSGAVTETALPSSVFNHSLANAVKSESGVTYNNNNNNNNVSVPCRESVPEIITTITVTTTTTTDSFSFLGQDVSLQIQQQQLDIEHLIMQRMEKVRMEIDEKRKRQARRIIEAIEVGVMKKLKTXEEEIEKIGKLNWALEEKVKHLCMENQVWRNIAETNEATANALRCNLEQVLAQRGGMAAEEDVGGGAXVCGGAEMDDAESCCGSTEEDGLEKETGGWRTLAGCAGVKDKEGGGNGRLCRNCRKEESCVLILPCRHLCLCTVCGSSLHICPICKSYKTASVHVNMS

SEQ ID NO: 341 - DNA, 444 bp, Arabidopsis thaliana
  misc_feature (1)..(444): Ceres CLONE ID no. 368
  misc_feature (1)..(444): Ceres SEED LINE: ME01754
  misc_feature: Encodes the peptide sequence given in SEQ ID no. 342
atatttaactatctctataaaaactttcatatattcctcttctttaaattaaaacacaaacactctcttctcttcataatcctcatctcatcatcactttgtcactaaatcagaatgaatccatccgagcagaatcacttgtccgtggaaaaaccttcacagacttcttcggggccgtacacaagtccaccaccgattggttatccgaccagagatgcgatggttggtgatcctccagccgccgcagtggagacaaagtccaagggcgatggtttttggaaaggatgttgtgctgccatatgctgctgttgtgtcctggatgcatgcttctgagacttcggaattaacgatttcatgcaaattattgatgtaataaaagagtatttgatgctagttatgttacctactctctgtttggaatatactctgtggatggttgttacc

SEQ ID NO: 342 - protein, 52 aa, Arabidopsis thaliana
  misc_feature (1)..(52): Ceres CLONE ID no. 368
  misc_feature (1)..(52): Ceres SEED LINE: ME01754
MRWLVILQPPQWRQSPRAMVFGKDVVLPYAAVVSWMHASETSELTISCKLLM

SEQ ID NO: 343 - DNA, 751 bp, Arabidopsis thaliana
  misc_feature (1)..(751): Ceres CLONE ID no. 41046
  misc_feature (1)..(751): Ceres SEED LINE: ME00900
  misc_feature: Encodes the peptide sequence given in SEQ ID no. 344
agcagcttcttctgctttcaattactctcgccgacgattttctcaccggaaaaaaacaatatcattgcggatacacaaactataatggacctcctcttgctggagaagtctttaatcgccgtcttcgtggcggtgattcttgccacggtgatttcaaagctccgcggcaagaaattgaagctacctccaggtcctataccaattccgatcttcggaaactggcttcaagtcggagatgatctcaaccaccgtaatctcgtcgattacgctaagaaattcggcgatctcttcctcctccgtatgggtcagcgaaacctagtcgtcgtctcctcaccggatctaacaaaggaagtgctcctcactcaaggcgttgagtttggatccagaacgagaaacgtcgtgttcgacattttcaccgggaaaggtcaagatatggtgttcactgtttacggcgagcattggaggaagatgagaagaatcatgacggttcctttcttcaccaacaaagttgttcaacagaatcgtgaaggttgggagtttgaagcagctagtgttgttgaagatgttaagaagaatccagattctgctacgaaaggaatcgtgttgaggaaacgtttgcaattgatgatgtataacaatatgttccgtatcatgttcgatagaagatttgagagtgaggatgatcctcttttccttaggcttaaggctttgaatggtgagagaatcttaaggcatcatcagctttagcttc

SEQ ID NO: 344 - protein, 220 aa, Arabidopsis thaliana
  misc_feature (1)..(220): Ceres CLONE ID no. 41046
  misc_feature (34)..(212): Pfam Name: p450 Pfam Description: Cytochrome P450
  misc_feature (1)..(220): Ceres SEED LINE: ME00900
MDLLLLEKSLIAVFVAVILATVISKLRGKKLKLPPGPIPIPIFGNWLQVGDDLNHRNLVDYAKKFGDLFLLRMGQRNLVVVSSPDLTKEVLLTQGVEFGSRTRNVVFDIFTGKGQDMVFTVYGEHWRKMRRIMTVPFFTNKVVQQNREGWEFEAASVVEDVKKNPDSATKGIVLRKRLQLMMYNNMFRIMFDRRFESEDDPLFLRLKALNGERILRHHQL

SEQ ID NO: 345 - DNA, 1058 bp, Arabidopsis thaliana
  misc_feature (1)..(1058): Ceres CLONE ID no. 4829
  misc_feature (1)..(1058): Ceres SEED LINE: ME00085
  misc_feature: Encodes the peptide sequence given in SEQ ID no. 346
aaaatataaaagagtgagaagaagaggacagagagaagaaaccattaccacacacacacagagaaacaaacccactccattaaaaaacaaagctttaagcttagattcaatcccaagtcagtaaaaatagggttaatcgaagaaccccaccggaattccactgaggaattgcatcagtcgcgttcttgttgcggcttgaggaagaaaaagaacacctacactaaccaaaacaagaacaaggacgaattgaaaccgaagatgacaacaacgaatgaagctactacacagcctcctcagcagatgatgagcttgagttttagtagtcagatgtctaaagaagacgaagagatggctcgttctgctctctctgcttttagggctaaagaagatgagattgagaagaggaaaatggaagttcgtgaaagggttaaggctcagcttggtcgtgttgaggaagagactcgtcgtcttgctagtatccgcgaggagcttgagacaatggcagatcccatgaggaaggaagttaattgggtgcgtaagaagattgatagcgtcaacaaagaactcaaaccattaggctcaactgttcaaaagaaggaaagggaatacaaagaagcattggatacgttcaacgagaagaatcgtgagaaagttcagctgatcaccaagctaatggagatgggacagttggttggagaaagcgagaagctgaggttgaagaagctggatgagctaagcaggagcatagacacagagagtgaatctatctcacaagacaagaccataccaatcaagaactaatttggtgtattttttctattttatttttacgttttggaatgttttcttagtttctgggtgttttagttttcttttgctatgatttgtgggttgatttgtaaaattatgatggggtttttcgtgtttttgattaaccattattgttagggaagggaaatgggataatgcttcttctgcttaggctactgaatgctaaaagggtttgtaagtttgaatttttttcttgctttgttttttctaatattattttatttgtt

SEQ ID NO: 346 - protein, 180 aa, Arabidopsis thaliana
  misc_feature (1)..(180): Ceres CLONE ID no. 4829
  misc_feature (1)..(166): Pfam Name: DUF662 Pfam Description: Family of unknown function (DUF662)
  misc_feature (1)..(180): Ceres SEED LINE: ME00085
MTTTNEATTQPPQQMMSLSFSSQMSKEDEEMARSALSAFRAKEDEIEKRKMEVRERVKAQLGRVEEETRRLASIREELETMADPMRKEVNWVRKKIDSVNKELKPLGSTVQKKEREYKEALDTFNEKNREKVQLITKLMEMGQLVGESEKLRLKKLDELSRSIDTESESISQDKTIPIKN

SEQ ID NO: 347 - protein, 156 aa, Arabidopsis thaliana
  misc_feature (1)..(156): Ceres CLONE ID no. 24885
  misc_feature (1)..(156): Pfam Name: DUF662 Pfam Description: Family of unknown function (DUF662)
  misc_feature (1)..(156): Functional Homolog of  Ceres CLONE ID no. 4829 at SEQ ID NO. 346 with e-value of 8.89E-62 and BLAST sequence identity of 87.2
MVLHTGSLSFSSHMSREDEEMTRSALSAFRAKEDEIEKRRMEVRERIQAQLGRVEQETKRLSTIREELESMADPMRKEVSVVRKKIDSVNKELKPLGSTVQKKEREYKEALDTFNEKNREKVQLITKLMEMEQLVGESEKLRMIKLEELSKSIETV

SEQ ID NO: 348 - protein, 175 aa, Arabidopsis thaliana
  misc_feature (1)..(175): Ceres CLONE ID no. 27878
  misc_feature (12)..(174): Pfam Name: DUF662 Pfam Description: Family of unknown function (DUF662)
  misc_feature (1)..(175): Functional Homolog of  Ceres CLONE ID no. 4829 at SEQ ID NO. 346 with e-value of 1.19E-57 and BLAST sequence identity of 84.2
MQAIETSQPTTVAPAVHSRQLGAQLSGSMSFSSQMSKEDEEMSRTALSAFRAKEEEIEKKKMEIRERVQAQLGRVEEETKRLALIREELEGLADPMRKEVAMVRKKIDSVNKELKPLGHTVQKKEREYKEALEAFNEKNREKVQLITRLMELVGESEKMRMKKLEELSKNIDSIH

SEQ ID NO: 349 - DNA, 498 bp, Populus balsamifera subsp. trichocarpa
  misc_feature (1)..(498): Ceres ANNOT ID no. 1485102
  misc_feature (1)..(498): Functional Homolog of  Ceres CLONE ID no. 4829 at SEQ ID NO. 346 with e-value of 1.50E-52 and BLAST sequence identity of 81.2
  misc_feature: Encodes the peptide sequence at SEQ ID No. 350
atggagcagcagcctcagcaacagaaccagctaacggtgcaaaactcaggcagccttagctttagcagccaaatgtctaaagaagatgaagagatgtcaaggtctgctctctctacttttagagccaaagaagaagagatcgaaaagaagaaaatggaggtcagagagaaggttcaagctcagttgggccgtgttgaggaggagaccaagcgcttagccatgattcgtgaggagcttgaagcgcttgcagatcccatgaggaaggaagttgctgttgtccgcaagaagattgatacagtgaacaaagaattgaagccattaggacatactgtgcagaagaaggagaaagaatacaaggatgcccttgaggccttcaatgataagaacaaggagaaagtacagctcataaccaaattaatggagctcgtgagtgaaagcgagaggttgaggctgaaaaagctggaggagctgagtaagaacatagactccatgcactga

SEQ ID NO: 350 - protein, 141 aa, Populus balsamifera subsp. trichocarpa
  misc_feature (1)..(141): Ceres ANNOT ID no. 1485102
  misc_feature (1)..(140): Pfam Name: DUF662 Pfam Description: Family of unknown function (DUF662)
  misc_feature (1)..(141): Functional Homolog of  Ceres CLONE ID no. 4829 at SEQ ID NO. 346 with e-value of 1.50E-52 and BLAST sequence identity of 81.2
MSKEDEEMSRSALSTFRAKEEEIEKKKMEVREKVQAQLGRVEEETKRLAMIREELEALADPMRKEVAVVRKKIDTVNKELKPLGHTVQKKEKEYKDALEAFNDKNKEKVQLITKLMELVSESERLRLKKLEELSKNIDSMH

SEQ ID NO: 351 - protein, 164 aa, Glycine max
  misc_feature (1)..(164): Ceres CLONE ID no. 1646533
  misc_feature (1)..(163): Pfam Name: DUF662 Pfam Description: Family of unknown function (DUF662)
  misc_feature (1)..(164): Functional Homolog of  Ceres CLONE ID no. 4829 at SEQ ID NO. 346 with e-value of 2.30E-54 and BLAST sequence identity of 72.8
MQSENQNNQLVVQNSGSLSFSSHLSKEDEEISRSALSTFRAKEEEIERKKMEVREKVQLQLGRVEEETKRLATIREELEALADPMRKEVALVRKRIDSVNKELKPLGHTCQKKEKEYKDALEAFNEKNREKVQLITKLMELVSESERLRMKKLEELSKNIDSIQ

SEQ ID NO: 352 - protein, 169 aa, Oryza sativa subsp. japonica
  misc_feature (1)..(169): Public GI no. 29371519
  misc_feature (37)..(168): Pfam Name: DUF662 Pfam Description: Family of unknown function (DUF662)
  misc_feature (1)..(169): Functional Homolog of  Ceres CLONE ID no. 4829 at SEQ ID NO. 346 with e-value of 5.99E-40 and BLAST sequence identity of 63.4
MQGEVDQPMQMVLRVKHPSSLGGGGGGGEEEAGEASSRSALSVFKAKEEQIERKKMEVREKVFAQLGRVEEESKRLAFIRQELEGMADPTRKEVEVIRKRIDVVNRQLKPLGKTCVKKEKEYKEILEAYNEKNKEKALLVNRLIELVSESERMRMKKLEELNKTVDSLY

SEQ ID NO: 353 - protein, 161 aa, Oryza sativa subsp. japonica
  misc_feature (1)..(161): Public GI no. 38347602
  misc_feature (29)..(160): Pfam Name: DUF662 Pfam Description: Family of unknown function (DUF662)
  misc_feature (1)..(161): Functional Homolog of  Ceres CLONE ID no. 4829 at SEQ ID NO. 346 with e-value of 5.99E-40 and BLAST sequence identity of 63.4
MQMVLRVKHPSSLGGGGGGGEEEAGEASSRSALSVFKAKEEQIERKKMEVREKVFAQLGRVEEESKRLAFIRQELEGMADPTRKEVEVIRKRIDVVNRQLKPLGKTCVKKEKEYKEILEAYNEKNKEKALLVNRLIELVSESERMRMKKLEELNKTVDSLY

SEQ ID NO: 354 - protein, 177 aa, Ipomoea trifida
  misc_feature (1)..(177): Public GI no. 45935148
  misc_feature (13)..(176): Pfam Name: DUF662 Pfam Description: Family of unknown function (DUF662)
  misc_feature (1)..(177): Functional Homolog of  Ceres CLONE ID no. 4829 at SEQ ID NO. 346 with e-value of 1.29E-39 and BLAST sequence identity of 60.8
MASPKQVMMEQQQQPQLQIPLLKNSGVISYSGNNPMGDDKAEEMTRTALSTFRAKEEEIERRRKEVTDRVQAQLGRMEEESKRLAEIREALEGFVDPAGKEAAMVRKKIDVVTRELKSLGQTCQRKEKEYKETLDAFNGKSKEKAQLITKLMELVSESERMRMKKLEELSKNVESLC

SEQ ID NO: 355 - protein, 157 aa, Zea mays
  misc_feature (1)..(157): Ceres CLONE ID no. 359934
  misc_feature (1)..(156): Pfam Name: DUF662 Pfam Description: Family of unknown function (DUF662)
  misc_feature (1)..(157): Functional Homolog of  Ceres CLONE ID no. 4829 at SEQ ID NO. 346 with e-value of 3.79E-38 and BLAST sequence identity of 60.4
MQIVCVRSASTGGGEEVGEWAEQSSRSALSLFKEKEEEIERKKVEVRDKVFSMLGRVEEETKRLAFIRQELELMADPTRREVDAIRKRIDKVNRQLKPLGKTCLKKEKEYKMCLEAYNEKNNEKATLVNRLLELVSESERLRMKKLEELNKTIESLY

SEQ ID NO: 356 - protein, 170 aa, Zea mays
  misc_feature (1)..(170): Ceres CLONE ID no. 294598
  misc_feature (9)..(169): Pfam Name: DUF662 Pfam Description: Family of unknown function (DUF662)
  misc_feature (1)..(170): Functional Homolog of  Ceres CLONE ID no. 4829 at SEQ ID NO. 346 with e-value of 5.99E-40 and BLAST sequence identity of 58.8
MQGGGGVDQPPMQMVLRVRHPSSLGGSGADEDDGEGSSRSALSVFKAKEEQIERRKMEVREKVFAHLGRVEEESKRLAFIRQELEGMADPTRKEVESIRKRIDTVNRQLKPLSKSCVKKEKEYKEVLEAYNEKSKEKALLVNRLIELVSESERMRMKKLEELNKTVDSLY

SEQ ID NO: 357 - protein, 159 aa, Triticum aestivum
  misc_feature (1)..(159): Ceres CLONE ID no. 839270
  misc_feature (7)..(158): Pfam Name: DUF662 Pfam Description: Family of unknown function (DUF662)
  misc_feature (1)..(159): Functional Homolog of  Ceres CLONE ID no. 4829 at SEQ ID NO. 346 with e-value of 3.10E-36 and BLAST sequence identity of 55.1
  misc_feature (101)..(101): Xaa is any aa, unknown, or other
  misc_feature (104)..(104): Xaa is any aa, unknown, or other
  misc_feature (105)..(105): Xaa is any aa, unknown, or other
  misc_feature (112)..(112): Xaa is any aa, unknown, or other
  misc_feature (116)..(116): Xaa is any aa, unknown, or other
  misc_feature (118)..(118): Xaa is any aa, unknown, or other
  misc_feature (141)..(141): Xaa is any aa, unknown, or other
  misc_feature (145)..(145): Xaa is any aa, unknown, or other
  misc_feature (154)..(154): Xaa is any aa, unknown, or other
  misc_feature (157)..(157): Xaa is any aa, unknown, or other
  misc_feature (159)..(159): Xaa is any aa, unknown, or other
MQMVLRVKHPSSLSSGSEEASEGEGSSRSALSVFKAKEEQIERKKMEVRDKVFAQLGRVEEESKRLAFIRQELEGMADPTRKEVESIQRRIDTVNRQLKPXSKXXVKKEKEXKEIXEXYNEKSKEKAILVNRLIELVSESXRMRXKKLEELNKXVDXLX

SEQ ID NO: 358 - DNA, 668 bp, Arabidopsis thaliana
  misc_feature (1)..(668): Ceres CLONE ID no. 5426
  misc_feature (1)..(668): Ceres SEED LINE: ME01902
  misc_feature: Encodes the peptide sequence given in SEQ ID no. 359
aacttaactccggcacgagtctcgttctcttctctttaccgccgtcatctaggtctgctaatatcaagtgaaggagctcgaaatggccacagttccaggacagttgatctgggagatcgtgaagagaaacaactgtttcttggtgaagcaattcggtagaggtaatgccaaggttcagttcagcaaagagagcaacaacctcgtcaacatcaactcgtacaagcactctggtttggccaacaaaaagacagtgaccattcaggcggctggcaaggaccaaggtgttgtactcggaaccaccaagactaagagacaaaacaagcctaagctctctgttaacaagtctatcctcaagaaggagttctcgaggatgagtaaagttgttgccaatcaggtagtggacaactactacaggcctgatttgaagaaagcagcacttgctaggcttagcgctatcagcaaaggtcttagagtagccaagtcgggtcccaagaggagaaacagacaggcttgaagaatccactactgaatatcttgtttactttttctaaaaagcttgttgtgagccattaagagtttctgacagcagcttgtaggttaagatttttcctgaacagctcaaggattgtaccaccatccttttttcactaaatgatattaaaactacc

SEQ ID NO: 359 - protein, 143 aa, Arabidopsis thaliana
  misc_feature (1)..(143): Ceres CLONE ID no. 5426
  misc_feature (5)..(136): Pfam Name: Ribosomal_L28e Pfam Description: Ribosomal L28e protein family
  misc_feature (1)..(143): Ceres SEED LINE: ME01902
MATVPGQLIWEIVKRNNCFLVKQFGRGNAKVQFSKESNNLVNINSYKHSGLANKKTVTIQAAGKDQGVVLGTTKTKRQNKPKLSVNKSILKKEFSRMSKVVANQVVDNYYRPDLKKAALARLSAISKGLRVAKSGPKRRNRQA

SEQ ID NO: 360 - protein, 135 aa, Brassica napus
  misc_feature (1)..(135): Ceres CLONE ID no. 1123542
  misc_feature (5)..(135): Pfam Name: Ribosomal_L28e Pfam Description: Ribosomal L28e protein family
  misc_feature (1)..(135): Functional Homolog of  Ceres CLONE ID no. 5426 at SEQ ID NO. 359 with e-value of 3.99E-59 and BLAST sequence identity of 90.3
MATVPGQLIWEIVKTNNCFLVKQFGRGNAKVQFSKETNNLCNLNSYKHSGLANKKTVTIQAADKEQGVVLATTKTKKQNKPKVSVNKSILKKEFSRMSKAVANQVVDNYYRPDLKKFALARLSVISKSLRVAKSG

SEQ ID NO: 361 - protein, 143 aa, Arabidopsis thaliana [sequence omitted]

SEQ ID NO: 362 - protein, 143 aa, Arabidopsis thaliana [sequence omitted]

SEQ ID NO: 363 - protein, 143 aa, Arabidopsis thaliana [sequence omitted]

SEQ ID NO: 364 - protein, 143 aa, Arabidopsis thaliana [sequence omitted]

SEQ ID NO: 365 - protein, 143 aa, Brassica napus
  misc_feature (1)..(143): Ceres CLONE ID no. 1068047
  misc_feature (5)..(136): Pfam Name: Ribosomal_L28e Pfam Description: Ribosomal L28e protein family
  misc_feature (1)..(143): Functional Homolog of  Ceres CLONE ID no. 5426 at SEQ ID NO. 359 with e-value of 2.39E-61 and BLAST sequence identity of 88.1
MATVPGQLIWEIVKTNNCFLVKQFGRGNAKVQFSKEKNNLCNLNSYKHSGLANKKTVTIQPADKDQGVVLATTKTKKQNKPKVSVNKSILKKEFPRMSKAVANQVVDNYYRPDLKKFALARLSVISKSIRVAKSGAKQRNRQA

SEQ ID NO: 366 - protein, 143 aa, Brassica napus
  misc_feature (1)..(143): Ceres CLONE ID no. 965035
  misc_feature (5)..(136): Pfam Name: Ribosomal_L28e Pfam Description: Ribosomal L28e protein family
  misc_feature (1)..(143): Functional Homolog of  Ceres CLONE ID no. 5426 at SEQ ID NO. 359 with e-value of 6.30E-61 and BLAST sequence identity of 87.4
MATVPGQLIWEIVKTNNCFLVKQFGRGNAKVQFSKEKNNLCNLNSYKHSGLANKKTVTIQPADKEQGVVLATTKTKKQNKPKVSVNKSILKKEFPRMSKAVANQVVDNYYRPDLKKFALARLSVISKSIRVAKSGAKQRNRQA

SEQ ID NO: 367 - DNA, 504 bp, Populus balsamifera subsp. trichocarpa
  misc_feature (1)..(504): Ceres ANNOT ID no. 1499194
  misc_feature (1)..(504): Functional Homolog of  Ceres CLONE ID no. 5426 at SEQ ID NO. 359 with e-value of 1.00E-53 and BLAST sequence identity of 76.7
  misc_feature: Encodes the peptide sequence at SEQ ID No. 368
atggcgacagtaccaggacaactgatatgggagatagttaagaagaataactgctttttggtgaagcagtttggaagaggaactgctagccttcggttcagcaaagagagcaacaatctctacaaccttaactcttacaagcactctggtttggcaaacaagaaaactgtcaccattcaggctggggacaaggatcaagctgtggttcttgctacaagtaagaccaagaagcagaacaaaccagcagctttgtttcacaaatctgtcatgaagaaggagttccgccgcatggctaaggctgtggagaaccaggtagaaggtaactattacaggcctgatctgaagaaagcagctcttgcaaggttgagtgctgtgcacaggagtcttaaggtagccaagtctggtgtcaagaagaggaatagacaagggttgaggaatttcaagcatgggcaccgcaacgagctaatcgggttgatttttaaagcttgctataaaaataagtga

SEQ ID NO: 368 - protein, 167 aa, Populus balsamifera subsp. trichocarpa
  misc_feature (1)..(167): Ceres ANNOT ID no. 1499194
  misc_feature (5)..(136): Pfam Name: Ribosomal_L28e Pfam Description: Ribosomal L28e protein family
  misc_feature (1)..(167): Functional Homolog of  Ceres CLONE ID no. 5426 at SEQ ID NO. 359 with e-value of 1.00E-53 and BLAST sequence identity of 76.7
MATVPGQLIWEIVKKNNCFLVKQFGRGTASLRFSKESNNLYNLNSYKHSGLANKKTVTIQAGDKDQAVVLATSKTKKQNKPAALFHKSVMKKEFRRMAKAVENQVEGNYYRPDLKKAALARLSAVHRSLKVAKSGVKKRNRQGLRNFKHGHRNELIGLIFKACYKNK

SEQ ID NO: 369 - DNA, 441 bp, Populus balsamifera subsp. trichocarpa
  misc_feature (1)..(441): Ceres ANNOT ID no. 1439584
  misc_feature (1)..(441): Functional Homolog of  Ceres CLONE ID no. 5426 at SEQ ID NO. 359 with e-value of 3.40E-53 and BLAST sequence identity of 75.5
  misc_feature: Encodes the peptide sequence at SEQ ID No. 370
atggcgacagtaccaggacaactgatatgggagatagttaagaagaataactcatttttggtgaagcagtttggaagaggaactgctagccttcagtttagcaaagaaaacaacaatctctacaaccttaactcttacaagcattctgggttggcaaacaagaaaactgtcactattcagcctgcggacaaggatcaagctgtggttcttgctacaaccaagaccaagaagcagaacaaacctgcagctttgcttcacaagtctgtcatgaagaaggagttcagccgcatggccaaggctgtggaaaaccaggttgcagataacaactacaggcctgatctgaagagagcagcccttgcaaggttgagtgtggtgcacaggagtctgaaggtatccaagtctggtgtcaagaagaggaatagacaagctttgaagaaatga

SEQ ID NO: 370 - protein, 146 aa, Populus balsamifera subsp. trichocarpa
  misc_feature (1)..(146): Ceres ANNOT ID no. 1439584
  misc_feature (5)..(136): Pfam Name: Ribosomal_L28e Pfam Description: Ribosomal L28e protein family
  misc_feature (1)..(146): Functional Homolog of  Ceres CLONE ID no. 5426 at SEQ ID NO. 359 with e-value of 3.40E-53 and BLAST sequence identity of 75.5
MATVPGQLIWEIVKKNNSFLVKQFGRGTASLQFSKENNNLYNLNSYKHSGLANKKTVTIQPADKDQAVVLATTKTKKQNKPAALLHKSVMKKEFSRMAKAVENQVADNNYRPDLKRAALARLSVVHRSLKVSKSGVKKRNRQALKK

SEQ ID NO: 371 - protein, 150 aa, Glycine max
  misc_feature (1)..(150): Ceres CLONE ID no. 557065
  misc_feature (5)..(136): Pfam Name: Ribosomal_L28e Pfam Description: Ribosomal L28e protein family
  misc_feature (1)..(150): Functional Homolog of  Ceres CLONE ID no. 5426 at SEQ ID NO. 359 with e-value of 5.60E-53 and BLAST sequence identity of 73.4
MATVPGQLIWEVVKKNNSFLVKEFGRGTQSVQFSREPNNLYNLNTFKYSGLANKKTVTVQPAGKDQSVLLATTKTKKQNKPAALLHKSVMKKEFRRMAKAVQNQVADNYYRPDLKKAALARLSAVNRSLRVAKSGVKKRNRQAVKVPSRK

SEQ ID NO: 372 - protein, 150 aa, Glycine max
  misc_feature (1)..(150): Ceres CLONE ID no. 465060
  misc_feature (5)..(136): Pfam Name: Ribosomal_L28e Pfam Description: Ribosomal L28e protein family
  misc_feature (1)..(150): Functional Homolog of  Ceres CLONE ID no. 5426 at SEQ ID NO. 359 with e-value of 1.29E-51 and BLAST sequence identity of 72.5
MATVPGQLVWEIVKKNNSFLVKQFGRGTQSVEFSRESNNLYNLNSFKYSGLANKKTVTVQPEGKDQAVLLATTKTKKQNKPAALLHKSVMKKEFRRMAKAVENQVAKNYYRPDLKKAALARLSAVHRSLKVAKSGVKKRNRQGVRVAGRK

SEQ ID NO: 373 - DNA, 1803 bp, Arabidopsis thaliana
  misc_feature (1)..(1803): Ceres CLONE ID no. 7894
  misc_feature (1)..(1803): Ceres SEED LINE: ME01704
  misc_feature: Encodes the peptide sequence given in SEQ ID no. 374
accactacaaccaccgcaacaaccaccaaaaaccctctcaaagaaatttcttttttttcttactttcttggtttgtcaaatatggtcagccatccaatggagaaagctgcaaatggtgcgtctgcgttggaaacgcagacgggtgagttagatcagccggaacggcttcgtaagatcatatcggtgtcttccattgccgccggtgtacagttcggttgggctttacagttatctctgttgactccttacgtgcagctactcggaatcccacataaatgggcttctctgatttggctctgtggtccaatctccggtatgcttgttcagcctatcgtcggttaccacagtgaccgttgcacctcaagattcggccgtcgtcgtcccttcatcgtcgctggagctggtttagtcaccgttgctgttttccttatcggttacgctgccgatataggtcacagcatgggcgatcagcttgacaaaccgccgaaaacgcgagccatagcgatattcgctctcgggttttggattcttgacgtggctaacaacaccttacaaggaccctgcagagctttcttggctgatttatcagcagggaacgctaagaaaacgcgaaccgcaaacgcgtttttctcgtttttcatggcggttggaaacgttttgggttacgctgcgggatcttacagaaatctctacaaagttgtgcctttcacgatgactgagtcatgcgatctctactgcgcaaacctcaaaacgtgttttttcctatccataacgcttctcctcatagtcactttcgtatctctctgttacgtgaaggagaagccatggacgccagagccaacagccgatggaaaagcctccaacgttccgtttttcggagaaatcttcggagctttcaaggaactaaaaagacccatgtggatgcttcttatagtcactgcactaaactggatcgcttggttccctttccttctcttcgacactgattggatgggccgtgaggtgtacggaggaaactcagacgcaaccgcaaccgcagcctctaagaagctttacaacgacggagtcagagctggtgctttggggcttatgcttaacgctattgttcttggtttcatgtctcttggtgttgaatggattggtcggaaattgggaggagctaaaaggctttggggtattgttaacttcatcctcgccatttgcttggccatgacggttgtggttacgaaacaagctgagaatcaccgacgagatcacggcggcgctaaaacaggtccacctggtaacgtcacagctggtgctttaactctcttcgccatcctcggtatcccccaagccattacgtttagcattccttttgcactagcttccatattttcaaccaattccggtgccggccaaggactttccctaggtgttctgaatctagccattgtcgtccctcagatggtaatatctgtgggaggtggaccattcgacgaactattcggtggtggaaacattccagcatttgtgttaggagcgattgcggcagcggtaagtggtgtattggcgttgacggtgttgccttcaccgcctccggatgctcctgccttcaaagctactatgggatttcattgaattttagcagtggttgtttggctctctttctctcataaaacagtagtgttgtgcaaatcctacataaagaaaaaagaaaaggaaattaaactcattgggttggtttgtattttacctaaacccacgaagttcctttttctttttgtaactcaatttaaatttggagtatattttactttttgc

SEQ ID NO: 374 - protein, 512 aa, Arabidopsis thaliana
  misc_feature (1)..(512): Ceres CLONE ID no. 7894
  misc_feature (35)..(467): Pfam Name: MFS_1 Pfam Description: Major Facilitator Superfamily
  misc_feature (1)..(512): Ceres SEED LINE: ME01704
MVSHPMEKAANGASALETQTGELDQPERLRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPKTRAIAIFALGFWILDVANNTLQGPCRAFLADLSAGNAKKTRTANAFFSFFMAVGNVLGYAAGSYRNLYKVVPFTMTESCDLYCANLKTCFFLSITLLLIVTFVSLCYVKEKPWTPEPTADGKASNVPFFGEIFGAFKELKRPMWMLLIVTALNWIAWFPFLLFDTDWMGREVYGGNSDATATAASKKLYNDGVRAGALGLMLNAIVLGFMSLGVEWIGRKLGGAKRLWGIVNFILAICLAMTVVVTKQAENHRRDHGGAKTGPPGNVTAGALTLFAILGIPQAITFSIPFALASIFSTNSGAGQGLSLGVLNLAIVVPQMVISVGGGPFDELFGGGNIPAFVLGAIAAAVSGVLALTVLPSPPPDAPAFKATMGFH

SEQ ID NO: 375 - protein, 508 aa, Brassica oleracea
  misc_feature (1)..(508): Public GI no. 18091781
  misc_feature (27)..(113): Pfam Name: Sugar_tr Pfam Description: Sugar (and other) transporter
  misc_feature (328)..(462): Pfam Name: MFS_1 Pfam Description: Major Facilitator Superfamily
  misc_feature (1)..(508): Functional Homolog of  Ceres CLONE ID no. 7894 at SEQ ID NO. 374 with e-value of 6.89E-261 and BLAST sequence identity of 94.6
MEKGSNGSAALEMQTSELDQPAALRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPRTRAIAIFALGFWILDVANNTLQGPCRAFLADLSAGNAKKTRTANAFFSFFMAVGNVLGYAAGSYKNLYKVVPFTMTKSCDLYCANLKTCFFLSITLLLLVTFMSLCYVTEKPWTPEPTADGKPSSVPFFGEIFGAFKELKRPMWMLLIVTALNWIAWFPFLLFDTDWMGREVYGGNSDATASVASKKLYNDGVRAGALGLMLNAIVLGFMSLGVEWVGRKMGGAKRLWGAVNFILAICLAMTVVVTKQAENHRRDHGGAKTGPPGNVTAGALTLFAVLGIPQAITFSIPFALASIFSTNSGAGQGLSLGVLNLAIVVPQMVVSVGGGPFDELFHGGNIPAFVLGAIAAAVSGILALTVLPSPPPDAPAFKTGAMGFH

SEQ ID NO: 376 - protein, 533 aa, Ricinus communis
  misc_feature (1)..(533): Public GI no. 468562
  misc_feature (41)..(206): Pfam Name: MFS_1 Pfam Description: Major Facilitator Superfamily
  misc_feature (418)..(489): Pfam Name: Sugar_tr Pfam Description: Sugar (and other) transporter
  misc_feature (1)..(533): Functional Homolog of  Ceres CLONE ID no. 7894 at SEQ ID NO. 374 with e-value of 2.39E-194 and BLAST sequence identity of 75.3
MQSSTSKENKQPPSSQPHPPPLMVAGAAEPNSSPLRKVVMVASIAAGIQFGWALQLSLLTPYVQLLGIPHTWAAFIWLCGPISGMLVQPIVGYHSDRCTSRFGRRRPFIASGAAFVAIAVFLIGYAADLGHLSGDSLDKSPKTRAIAIFVVGFWILDVANNMLQGPCRALLADLSGTSQKKTRTANALFSFFMAVGNVLGYAAGAYTHLYKLFPFTKTTACDVYCANLKSCFFISIVLLLSLTVLALSYVKEKPWSPDQAVDNAEDDTASQASSSAQPMPFFGEILGAFKNLKRPMWILLLVTCLNWIAWFPFLLFDTDWMGREVYGGDSSGSAEQLKLYDRGVRAGALGLMLNSVVLGFTSLGVEVLARGVGGVKRLWGIVNFVLAVCLAMTVLVTKQAESTRRFATVSGGAKVPLPPPSGVKAGALALFAVMGVPQAITYSIPFALASIFSNTSGAGQGLSLGVLNLSIVIPQMIVSVAAGPWDALFGGGNLPAFVVGAVAALASGIFALTMLPSPQPDMPSAKALTAAFH

SEQ ID NO: 377 - DNA, 1608 bp, Populus balsamifera subsp. trichocarpa
  misc_feature (1)..(1608): Ceres ANNOT ID no. 1479767
  misc_feature (1)..(1608): Functional Homolog of  Ceres CLONE ID no. 7894 at SEQ ID NO. 374 with e-value of 4.30E-188 and BLAST sequence identity of 74.7
  misc_feature: Encodes the peptide sequence at SEQ ID No. 378
atggagagtggagttagaaaagaagacaaacccccttcctcctctgtcaatcttcaacaacaacaacaactgccctcctcagtaaaacctggcccgttaaaaaagatcataatggttgcatcaatagcagctggggttcaatttggttgggcactacagctctctttgttaaccccatatgtgcaacttttaggcattcctcacacatgggcagctttcatttggctctgtgggccgatttctggtatgttagtccagccagtagttggctaccacagtgaccgctgcacatctcgttttggccgtcgccgaccatttatcgcggcgggggctgctttcgtcaccattgccgtgtttctcattggctatgccgctgacattggccacctttctggtgattccctaaccaaaacagctaaaccacgagccattgctgtgtttgttgtagggttttggattcttgatgttgctaataacatgcttcaaggtccatgtagggcatttcttgctgatctttcagggacgaatcagaagaagacacgtacatccaatgctttcttctctttctttatggctgttggcaatgttcttggctatgcagctgggtcttacactcacttatacaaactttttccattttcaagaaccaaagcttgtgatgtctactgtgcaaacctcaaatcttgcttctttatctctattgccttgcttttaacgttaacaattctagctctctcttacgtacgtgaaaaaccctggtcgccggagggaagtcccggtgaaggcggtgacgaggaggaggaagaggaggcgattggagaagccaaagagtcggcgccaatgcccttttttggggaaatatttgctgctttgaagaacttgcaaagacctatgtggatcctacttttggtgacgtgtctaaattgggttgcttggttccctttcctgttgtttgatactgattggatggggagagaggtttacggtggtgattcaagtggaaatgctgatcaactcaagatgtatgatcgtggggtccgtgcaggtgcattggggttgatgcttaactcggtggttttgggagttacttcgcttggtgtggaggctttggctcgtggggttggtggggttaagaggctgtgggggattgtgaattttgtcttggctatttgtttggctatgactattttgataaccaaattggctcagtccaacagaaggtacaccaccgtgaatggaggaacccacctcttgacgccgccgcctggtatcaaggctggtgctttagccctttttgccgttatgggcatacctcaagctataacttacagcatcccttttgctctggcatcaatcttttctaacacctctggtgctggccaagggctttctctgggagttctcaatctgtcaatagttataccacagatgttggtgtctgtagcaagtggaccttgggatgccctttttggaggaggtaatccaccagcttttgtagtaggagctgttgcagccgcagttagtggaatattggcgttcaccatgcttccatctccacctcctgacatcccctcaaacaaaatggctgtcactgctgcattccattga

SEQ ID NO: 378 - protein, 498 aa, Populus balsamifera subsp. trichocarpa
  misc_feature (1)..(498): Ceres ANNOT ID no. 1479767
  misc_feature (2)..(167): Pfam Name: MFS_1 Pfam Description: Major Facilitator Superfamily
  misc_feature (383)..(453): Pfam Name: Sugar_tr Pfam Description: Sugar (and other) transporter
  misc_feature (1)..(498): Functional Homolog of  Ceres CLONE ID no. 7894 at SEQ ID NO. 374 with e-value of 4.30E-188 and BLAST sequence identity of 74.7
MVASIAAGVQFGWALQLSLLTPYVQLLGIPHTWAAFIWLCGPISGMLVQPVVGYHSDRCTSRFGRRRPFIAAGAAFVTIAVFLIGYAADIGHLSGDSLTKTAKPRAIAVFVVGFWILDVANNMLQGPCRAFLADLSGTNQKKTRTSNAFFSFFMAVGNVLGYAAGSYTHLYKLFPFSRTKACDVYCANLKSCFFISIALLLTLTILALSYVREKPWSPEGSPGEGGDEEEEEEAIGEAKESAPMPFFGEIFAALKNLQRPMWILLLVTCLNWVAWFPFLLFDTDWMGREVYGGDSSGNADQLKMYDRGVRAGALGLMLNSVVLGVTSLGVEALARGVGGVKRLWGIVNFVLAICLAMTILITKLAQSNRRYTTVNGGTHLLTPPPGIKAGALALFAVMGIPQAITYSIPFALASIFSNTSGAGQGLSLGVLNLSIVIPQMLVSVASGPWDALFGGGNPPAFVVGAVAAAVSGILAFTMLPSPPPDIPSNKMAVTAAFH

SEQ ID NO: 379 - protein, 530 aa, Euphorbia esula
  misc_feature (1)..(530): Public GI no. 7649151
  misc_feature (35)..(485): Pfam Name: MFS_1 Pfam Description: Major Facilitator Superfamily
  misc_feature (1)..(530): Functional Homolog of  Ceres CLONE ID no. 7894 at SEQ ID NO. 374 with e-value of 9.99E-194 and BLAST sequence identity of 74.3
METQLATKNPSSQPPPPPPELAAPPSSNLKKIVVVASIAAGVQFGWALQLSLLTPYVQLLGIPHTWAAFIWLCGPISGMLVQPIVGYHSDRCTSRFGRRRPFIAAGAASVAVAVFLIGYAADLGHMSGDSIGKSPKIRAIAIFVVGFWILDVANNMLQGPCRALLADLSGTSQKKTRLANALFSFFMAVGNILGYAAGAYTHLYKIAPFTLTKACDVYCANLKTCFFISIALLLVLTVIALTYVKEKQWSPEIAKTVAGVDGDDEDGPVEAAPLPFFGEIFAALKNLQRPMRILLLVTCLNWIAWFPFLLFDTDWMGREVYGGSSDSSATAGESKLYDRGVRAGALGLMLNSVVLGFTSLGVELMARKLGKVKRLWGIVNFLLAICLALTILITKLAESGRHYPTVNGVVSTTPSPPSSGIKAGALTLFAVMGIPQAITYSVPFALASIFSNDSGAGQGLSLGVLNLSIVIPQMLVSVASGPFDALFGGGNLPAFVVGAVAAAASGVLALTYLPSPPPDLPAKALTVGFH

SEQ ID NO: 380 - DNA, 1608 bp, Populus balsamifera subsp. trichocarpa
  misc_feature (1)..(1608): Ceres ANNOT ID no. 1486712
  misc_feature (1)..(1608): Functional Homolog of  Ceres CLONE ID no. 7894 at SEQ ID NO. 374 with e-value of 3.70E-182 and BLAST sequence identity of 72.5
  misc_feature: Encodes the peptide sequence at SEQ ID No. 381
atggagagtggagttagaaaagaaaacaatcccccttcctcttctttcagtcttcaacaacaacctcctgcaacaaaccctagcccactgagaaagatcataatggttgcatcgatagctgctggtgttcaatttggttgggcgctacagctctctttgttaaccccatatgtgcaactcttgggcattcctcacacatgggctgctttcatctggctttgcggcccgatttctggcatgttagtccagccaacagtggggtactacagtgaccgatgcacctcccgttttggccgtcgtagcccgtttattgcggcgggggctggttttgttgccatttctgtgtttctcattggctatgccgctgacattggccatctctctggtgattccctcacaaaaacagctaagccacgcgcaattgctgtgtttgtggtagggttctggattcttgatgttgctaataacatgcttcaaggtccatgtagggcatttcttgctgatctttcagggacggatcacaagaagactcgtacagccaatgctttctactctttctttatggctgttggcaatgttcttggctttgcatctgggtcttacactcacttgtacagaatctttccattttcaagaaccaaggcttgtgatgtttactgtgcaaatctcaaatcttgtttcttcatctccattgccttgcttttaacgttgacaattctagctctctcttacgtacgtgaaaaaccctggtcgccggagggaagttccggtgacggaggtaacgaggaggagaaagaggtggagggtggagaagctaaagagtcgacgccagcgcctttttttggggaaatagtcgctgctcttaagaacttgcaaagacctatgaggatcctccttttggtgacgtgtctaaactgggttgcgtggtttcctttcttgttgtttgatactgattggatggggagagaggtgtacggtggtgattcaagtagaaatgctgatcaactgaagatgtatgatcgtggggtccatgcaggtgcattggggttactgcttaactcggtggttttgggattcacttcacttggtgtggaggttttggctcgtggggttggcggggttaaaaggctgtgggggattgtaaattttatcttggctatttgtttggctatgactattttgatcaccaaagtggctcaatctaacagaaggtacaccaccgtgaatggaggaacccacctcttgccgccgccatctggtgtcaaggctggtgctctagccctttttgctgttatgggcatacctcaagctataacttacagcatcccttttgctttggcatccatcttttctaacacttcgggtgctggccaagggctttctcttggagttctcaatctttcaatagttataccacagatggtggtttctgtagcagctggaccttgggatgccctttttggaggaggaaatctaccagcttttgttgtaggagcggttgcagctgcagccagtggaatattggcattcaccatgcttccatctccgccccctgacatcccctcaaacaagagggctgccaccagtagtagtgctgcattccattga

SEQ ID NO: 381 - protein, 501 aa, Populus balsamifera subsp. trichocarpa
  misc_feature (1)..(501): Ceres ANNOT ID no. 1486712
  misc_feature (2)..(167): Pfam Name: MFS_1 Pfam Description: Major Facilitator Superfamily
  misc_feature (382)..(453): Pfam Name: Sugar_tr Pfam Description: Sugar (and other) transporter
  misc_feature (1)..(501): Functional Homolog of  Ceres CLONE ID no. 7894 at SEQ ID NO. 374 with e-value of 3.70E-182 and BLAST sequence identity of 72.5
MVASIAAGVQFGWALQLSLLTPYVQLLGIPHTWAAFIWLCGPISGMLVQPTVGYYSDRCTSRFGRRSPFIAAGAGFVAISVFLIGYAADIGHLSGDSLTKTAKPRAIAVFVVGFWILDVANNMLQGPCRAFLADLSGTDHKKTRTANAFYSFFMAVGNVLGFASGSYTHLYRIFPFSRTKACDVYCANLKSCFFISIALLLTLTILALSYVREKPWSPEGSSGDGGNEEEKEVEGGEAKESTPAPFFGEIVAALKNLQRPMRILLLVTCLNWVAWFPFLLFDTDWMGREVYGGDSSRNADQLKMYDRGVHAGALGLLLNSVVLGFTSLGVEVLARGVGGVKRLWGIVNFILAICLAMTILITKVAQSNRRYTTVNGGTHLLPPPSGVKAGALALFAVMGIPQAITYSIPFALASIFSNTSGAGQGLSLGVLNLSIVIPQMVVSVAAGPWDALFGGGNLPAFVVGAVAAAASGILAFTMLPSPPPDIPSNKRAATSSSAAFH

SEQ ID NO: 382 - protein, 520 aa, Glycine max
  misc_feature (1)..(520): Public GI no. 33620334
  misc_feature (286)..(323): Pfam Name: Sugar_tr Pfam Description: Sugar (and other) transporter
  misc_feature (37)..(208): Pfam Name: MFS_1 Pfam Description: Major Facilitator Superfamily
  misc_feature (1)..(520): Functional Homolog of  Ceres CLONE ID no. 7894 at SEQ ID NO. 374 with e-value of 3.29E-181 and BLAST sequence identity of 71.9
MEPFSSTKQNHNNNNTLTKPSLHVESPPLEPSPLRKIIVVASIAAGVQFGWALQLSLLTPYVQLLGIPHTWAAYIWLCGPISGMLVQPIVGYHSDRCTSRFGRRRPFIAAGSFAVAIAVFLIGYAADLGHSFGDDLSKKVRPRAIGIFVVGFWILDVANNMLQGPCRALLGDLCAGNHQKTRNANAFFSFFMAVGNVLGYAAGAYSKLYHVFPFTKTTACDVYCANLKSCFFLSIALLTTLATAALVYVKEVPLSPEKAVIDSDDNGGMPCFGQLFGAFRELKRPMWILLLVTCLNWIAWFPFLLFDTDWMGREVYEGTVGEGKAYDRGVRAGALGLMLNSVVLGATSLGVEVLARGVGGVKRLWGIVNFLLAVCLAMTVLVTKMAQHSRQYTLLPNAHQEPLPPPAAVKAGALALFSLLGIPLAITYSIPFALASIFSSTSGAGQGLSLGVLNLAIVIPQMVVSVISGPWDALFGGGNLPAFVVGAVAAAASGILSIILLPSPPPDLAKAATAAGGGFH

SEQ ID NO: 383 - protein, 516 aa, Solanum tuberosum
  misc_feature (1)..(516): Public GI no. 439294
  misc_feature (36)..(466): Pfam Name: MFS_1 Pfam Description: Major Facilitator Superfamily
  misc_feature (1)..(516): Functional Homolog of  Ceres CLONE ID no. 7894 at SEQ ID NO. 374 with e-value of 4.39E-179 and BLAST sequence identity of 71.6
MENGTKREGLGKLTVSSSLQVEQPLAPSKLWKIIVVASIAAGVQFGWALQLSLLTPYVQLLGIPHKFASFIWLCGPISGMIVQPVVGYYSDNCSSRFGRRRPFIAAGAALVMIAVFLIGFAADLGHASGDTLGKGFKPRAIAVFVVGFWILDVANNMLQGPCRALLADLSGGKSGRMRTANAFFSFFMAVGNILGYAAGSYSHLFKVFPFSKTKACDMYCANLKSCFFIAIFLLLSLTTIALTLVRENELPEKDEQEIDEKLAGAGKSKVPFFGEIFGALKELPRPMWILLLVTCLNWIAWFPFFLYDTDWMAKEVFGGQVGDARLYDLGVRAGAMGLLLQSVVLGFMSLGVEFLGKKIGGAKRLWGILNFVLAICLAMTILVTKMAEKSRQHDPAGTLMGPTPGVKIGALLLFAALGIPLAATFSIPFALASIFSSNRGSGQGLSLGVLNLAIVVPQMLVSLVGGPWDDLFGGGNLPGFVVGAVAAAASAVLALTMLPSPPADAKPAVAMGLSIK

SEQ ID NO: 384 - protein, 534 aa, Populus tremula x Populus tremuloides
  misc_feature (1)..(534): Public GI no. 77153413
  misc_feature (36)..(481): Pfam Name: MFS_1 Pfam Description: Major Facilitator Superfamily
  misc_feature (1)..(534): Functional Homolog of  Ceres CLONE ID no. 7894 at SEQ ID NO. 374 with e-value of 8.90E-181 and BLAST sequence identity of 71.6
MESGVRKENNPPSSSFSLQQQPPATNPSPLRKIIVVASIAAGVQFGWALQLPLLTPYVQLLGIPHTWAAFIWLCGPISGMLVQPTVGYYSDRCTSRFGRRRPFIAAGAGFVAISVFLIGYAADIGHLSGDSLTKTAKPRAIAVFVVGFWILDVANNMLQGPCRAFLADLSGKDHKKTRTANAFYSFFMAVGNVLGFASGSYTHLYRIFPFSRTKACDVYCANLKSCFFISIALLLTLTILALSYVREKPWSPEGSSGEGGNEEEKEEEGGEAKESTPAPFFGEIVAALKNLQRPMRILLLVTCLNWIAWFPFLLFDTDWMGREVYGGDSSRNTDQLKMYDRGVRAGALGLLLNSVVLGFTSLGVEVLARGVGGVKRLWGIVNFILAICLAMTILITKVAQSNRRYTTVNGGTHLLPPPSGVKAGALALFAVMGIPQAITYSIPFALASIFSNTSGAGQGLSLGVLNLSIVISQMEVSVAAGSWDALFGGGNLPAFVVRAVAAAASGILAFTMLPSPAPDIPSNKRAATSTLAFI

SEQ ID NO: 385 - protein, 524 aa, Pisum sativum
  misc_feature (1)..(524): Public GI no. 5230818
  misc_feature (290)..(327): Pfam Name: Sugar_tr Pfam Description: Sugar (and other) transporter
  misc_feature (1)..(524): Functional Homolog of  Ceres CLONE ID no. 7894 at SEQ ID NO. 374 with e-value of 1.40E-180 and BLAST sequence identity of 71.1
MEPLSSTKQINNNNNNLAKPSSLHVETQPLEPSPLRKIMVVASIAAGVQFGWALQLSLLTPYVQLLGIHHTWAAYIWLCGPISGMLVQPVVGYHSDRCTSRFGRRRPFIAAGSIAVAIAVFLIGYAADLGHSFGDNLDKKVRPRAIGIFVVGFWILDVANNMLQGPCRALLGDLCAGNQRKTRNANAFFSFFMAVGNVLGYAAGAYSKLYHVFPFTKTEACNVYCANLKSCFFLSIALLTVLATAALIYVKETPLIAEKAVVTAEDGGSNGGMPCFGQLSGAFKELKRPMWILLLVTCLNWIAWFPFLLFDTDWMGKEVYGGTVGEGHAYDMGVRAGALGLMLNSVVLGATSLGVDILARGVGGVKRLWGIVNFLLAICLGLTVLVTKLAQHSRQYAPGTGGLQDPLPPSGGIKAGALTLFSVLGIPLAITYSIPFALASIFSSTSGAGQGLSLGVLNLAIVIPQMFVSVLSGPWDALFGGGNLPAFVVGAVAALASGILSMILLPSPPPDMAKSVSATGGGFH

SEQ ID NO: 386 - protein, 502 aa, Alonsoa meridionalis
  misc_feature (1)..(502): Public GI no. 17447420
  misc_feature (26)..(476): Pfam Name: MFS_1 Pfam Description: Major Facilitator Superfamily
  misc_feature (1)..(502): Functional Homolog of  Ceres CLONE ID no. 7894 at SEQ ID NO. 374 with e-value of 1.29E-179 and BLAST sequence identity of 70.9
MEVGNEAKSTALPPAQAAPVKNIIVVAAIAAGVQFGWALQLSLLTPYVQLLGVPHVWAAFIWLCGPISGLLVQPIVGYYSDNCTSRFGRRRPFIAAGAGLVAVAVFLIGFAADLGHMGGDSLGKGTKPRAVAVFVVGFWILDVANNMLQGPCRALLADMSAGNAKKMSSANSMFSFFMAVGNVLGYAAGSYTRLYKVFPFSKTEACAVYCANLKSCFFISVALLLTVTIIALCIVRETPYTAPPEEAGTVKKHTVPVFGELFGALKDLPRPMWMLLLVTALNWVAWFPFLLFDTDWMGKEVYGGKVGEGSLYDKGVRVGALGLMLNSVVLGVASLGVQVTARGLGGVKRLWGSVNLLLAICLAMTVLITKMAQHHREYASVGGAAPTLQPPVHGVKIGALALFSVLGIPLAATFSIPFALASIYSSNSGAGQGLSLGVLNLAIVIPQMFVSVASGPWDALFGGGNLPAFVVGAVAATVSGIIALTALPSPPSDVKILATGGH

SEQ ID NO: 387 - protein, 523 aa, Vicia faba
  misc_feature (1)..(523): Public GI no. 1935019
  misc_feature (37)..(208): Pfam Name: MFS_1 Pfam Description: Major Facilitator Superfamily
  misc_feature (407)..(478): Pfam Name: Sugar_tr Pfam Description: Sugar (and other) transporter
  misc_feature (1)..(523): Functional Homolog of  Ceres CLONE ID no. 7894 at SEQ ID NO. 374 with e-value of 4.39E-179 and BLAST sequence identity of 70.8
MEPLSSTKQINNNNNLAKPSSLHVETQPLEPSPLRKIMVVASIAAGVQFGWALQLSLLTPYVQLLGIHHTWAAYIWLCGPISGMLVQPIVGYHSDRCTSRFGRRRPFIAAGSIAVAIAVFLIGYAADLGHSFGDSLDQKVRPRAIGIFVVGFWILDVANNMLQGPCRALLGDLCAGNQRKTRNANAFFSFFMAVGNVLGYAAGAYSKLYHVFPFTKTKACNVYCANLKSCFFLSIALLTVLATSALIYVKETALTPEKTVVTTEDGGSSGGMPCFGQLSGAFKELKRPMWILLLVTCLNWIAWFPFLLFDTDWMGKEVYGGTVGEGHAYDMGVREGALGLMLNSVVLGATSLGVDILARGVGGVKRLWGIVNFLLAICLGLTVLVTKLAQHSRQYAPGTGALGDPLPPSEGIKAGALTLFSVLGVPLAITYSIPFALASIFSSTSGAGQGLSLGVLNLAIVIPQMFVSVLSGPWDALFGGGNLPAFVVGAVAALASGILSIILLPSPPPDMAKSVSATGGGFH

SEQ ID NO: 388 - protein, 516 aa, Juglans regia
  misc_feature (1)..(516): Public GI no. 51863031
  misc_feature (24)..(466): Pfam Name: MFS_1 Pfam Description: Major Facilitator Superfamily
  misc_feature (1)..(516): Functional Homolog of  Ceres CLONE ID no. 7894 at SEQ ID NO. 374 with e-value of 8.79E-174 and BLAST sequence identity of 69.6
MEVESANKDMRAAQRSTLIRIVLVASIAAGVQFGWALQLSLLTPYVQLLGIPHTWAAFIWLCGPISGMLVQPIVGYYSDRCTSRFGRRRPFIAVGACFVAMAVFLIGYAADLGHLCGDHVDKPTRPRAIAFFVVGFWVLDVSNNMLQGPCRALLADLSGNDQKKMRTSNALFSFFMAVGNVLGYAAGSYTRFYKIFPFTKTKACDVYCANLKSCFFLSIALLSTVTILALTSVKERALSSQPKPENAAGEDEERVTESAGLPFFGEMWSAFKGLQRPMRILLLVTCLNWIAWFPFLLFDTDWMGKEVYGGTVERSGGKIVRSGVRAGALGLMLNSVVWGFTSLGVNVISRGIGGVKRLWGIVNFLLALCMAMTVLITKLAESARHTAAANGGATLSPPPAGVKAGALALFAVLGIPLAVTYSIPFALASIFSHASGAGQGLSLGVLNLAIVFPQMLVSVASGPFDALFGGGNLPAFVVGAISAAASGILSLTMLPFPTTDLLCFLKMQYPQFPAFH

SEQ ID NO: 389 - protein, 507 aa, Nicotiana tabacum
  misc_feature (1)..(507): Public GI no. 575351
  misc_feature (30)..(462): Pfam Name: MFS_1 Pfam Description: Major Facilitator Superfamily
  misc_feature (1)..(507): Functional Homolog of  Ceres CLONE ID no. 7894 at SEQ ID NO. 374 with e-value of 4.39E-179 and BLAST sequence identity of 69.3
MENGTKKLNVSSLAVEQPLPKSKLWKIIMVASIAAGVQFGWALQLSLLTPYVQLLGIPHKFASFIWLCGPISGMIVQPVVGYYSDNCSSRFGRRRGFIAAGAALVTIAVFLIGFAADLGHATGDPLGKGSKPRAIAVFVVGFWILDVANNMLQGPCRALLADLSGGKARMRTSNAFFSFFMAVGNVLGYAAGSYSRLCKIFPFSKTPACDIYCANLKSCFFIAVFLLLSLTILALTVVRENELPEKDEHEIDEKAGARKSKVPFFGEIFGALKDLPRPMWILLLVTSLNWIARFPFFLYDTDWMAKEVYGGKVGDGRLYDLGVHAGALGLLLNSVVLGFMSLSVEFLGKKIGGVKRLWGILNFVLAVCMALTVLVTKMAEKSRQYDAHGTLMAPTSGVKIGALTLFAVLGIPLAVTFSVPFALASIFSSNAGSGQGLSLGVLNLAIVVPQMLVSIAGGPWDDLFGGGNLPGFIVGAVAAAASGILALTMLPSPPADAKPATTMGGFH

SEQ ID NO: 390 - protein, 505 aa, Vitis vinifera
  misc_feature (1)..(505): Public GI no. 68161544
  misc_feature (389)..(458): Pfam Name: Sugar_tr Pfam Description: Sugar (and other) transporter
  misc_feature (1)..(505): Functional Homolog of  Ceres CLONE ID no. 7894 at SEQ ID NO. 374 with e-value of 7.39E-177 and BLAST sequence identity of 68.7
MELAKPSSVFAIQDHQSSSPPTPIWKTVVVASIAAGIQFGWALQLSLLTPYVQLLGIPHKWAAFIWLCGPISGMIVQPVVGYHSDRCTSRFGRRRPFIAAGAVLVAIAVFLIGYAADIGRVSGDPLHNTIKTRAVAVFVVGFWILDVANNMLQGPCRALLADLSGTSARRTRTANALYSFFMAVGNVLGYAAGSFSKLHKMFPFARTQACDLYCANLKSCFFLSIALLLILTIIAFATVHETPLNRADIAVVEAGQPFYSQMMNAFRQLRRPMWVLLLVTCLNWIGWFPFLLFDTDWMGREVYGGTVGEGPRGRLYDLGVRAGSLGLMLNSVVLGLMSLGVEFFGRGVGGVKRLWGGVNFLLALCLALTVLVSKLAASWRHSLGGELHPPPIGIKAGALSLFAVMGVPLAITYSIPFALASIFCHSSGAGQGLSLGVLNLAIVVPQMMVSVASGPWDARFGGGNLPAFVVGAFAAALSGVLALTMLPAPPPDVPNTKDERTQPSS

SEQ ID NO: 391 - protein, 505 aa, Vitis vinifera
  misc_feature (1)..(505): Public GI no. 6434833
  misc_feature (389)..(458): Pfam Name: Sugar_tr Pfam Description: Sugar (and other) transporter
  misc_feature (1)..(505): Functional Homolog of  Ceres CLONE ID no. 7894 at SEQ ID NO. 374 with e-value of 1.49E-176 and BLAST sequence identity of 68.5
MELAKPSSVFAIQDHQSSSPPTPIWKTVVVASIAAGIQFGWALQLSLLTPYVQLLGIPHKWAAFIWLCGPISGMIVQPVVGYHSDRCTSRFGRRRPFIAAGAVLVAIAVFLIGYAADIGRVSGDPLHNTIKTRAVAVFVVGFWILDVANNMLQGPCRALLADLSGTSARRTRTANALYSFFMAVGNVLGYAAGSFSKLHKMFPFARTQACDLYCANLKSCFFLSIALLLILTIIAFATVHETPLNRADIAVVEAGQPFYSQMMNAFRQLRRPMWVLLLVTCLNWIGWFPFLLFDTDWMGREVYGGTVGEGPRGRLYDLGVRAGSLGLMLNSVVLGLMSLGVEFFGRGVGGVKRLWGGVNFLLALCLALTVLVSKLAASWRHSLGGELHPPPIGIKAGALSLFAVMGVPLAITYSIPFALASIFCHSSGAGQGLSLGVLNLAIVVPQMMVSVASGPWDARFGGGNLPAFVVGAFAAALNGVLALTMLPAPPPDVPNTKDERTQPSS

SEQ ID NO: 392 - protein, 525 aa, Spinacia oleracea
  misc_feature (1)..(525): Public GI no. 21319
  misc_feature (41)..(498): Pfam Name: MFS_1 Pfam Description: Major Facilitator Superfamily
  misc_feature (1)..(525): Functional Homolog of  Ceres CLONE ID no. 7894 at SEQ ID NO. 374 with e-value of 9.99E-173 and BLAST sequence identity of 68.2
MAGRNIKNGENNKIAGSSLHLEKNPTTPPEAEATLKKLGLVASVAAGVQFGWALQLSLLTPYVQLLGIPHTWAAYIWLCGPISGMIVQPLVGYYSDRCTSRFGRRRPFIAAGAALVAVAVGLIGFAADIGAASGDPTGNVAKPRAIAVFVVGFWILDVANNTLQGPCRALLADMAAGSQTKTRYANAFFSFFMALGNIGGYAAGSYSRLYTVFPFTKTAACDVYCANLKSCFFISITLLIVLTILALSVVKERQITIDEIQEEEDLKNRNNSSGCARLPFFGQLIGALKDLPKPMLILLLVTALNWIAWFPFLLFDTDWMGKEVYGGTVGEGKLYDQGVHAGALGLMINSVVLGVMSLSIEGLARMVGGAKRLWGIVNIILAVCLAMTVLVTKSAEHFRDSHHIMGSAVPPPPPAGVKGGALAIFAVLGIPLAITFSIPFALASIFSASSGSGQGLSLGVLNLAIVVPQMFVSVTSGPWDAMFGGGNLPAFVVGAVAATASAVLSFTLLPSPPPEAKIGGSMGGH

SEQ ID NO: 393 - protein, 539 aa, Beta vulgaris
  misc_feature (1)..(539): Public GI no. 5823000
  misc_feature (39)..(482): Pfam Name: Sugar_tr Pfam Description: Sugar (and other) transporter
  misc_feature (1)..(539): Functional Homolog of  Ceres CLONE ID no. 7894 at SEQ ID NO. 374 with e-value of 2.69E-170 and BLAST sequence identity of 67.7
MEGRNVKNGDTNNNKIVGSSLSIEKNPISPPEASSLKKLALVASIAAGVQFGWALQLSLLTPYVQLLGIPHTWAPYIWLCGPISGMIVQPTVGYYSDRCTSKFGRRSPFIAVGATLVGFAVSLIGFAADIGHATGDPNGNVPKPRAIAVFVVGFWILDVANNTLQGPCRALLADMAAGSQAKTRYANAFFSFFMALGNIGGYAAGSYSRLYTVFPFTHTKACDTYCANLKSCFFISITLLIVLTILALSVVRERPFTLDEIQEEENLKNNTGGCARLPFFGQLFGALKDLPKPMLILLLVTCLNWIAWFPFLLFDTDWMGKEVYGGTVGEGKAYDMGVHAGALGLMINSVVLGIMSLGIEKLARLVGGVKRLWGIVNLILAVCLAMTILVTKSAEHYRATHHVPGAIGPPLPPPGFKGGALAIFSVLGIPLAITFSIPFALASIFSASSGSGQGLSLGVLNLAIVVPQMFVSVTSGPWDALFGGGNLPAFVVGAVAATASAILSFTLLPSPHRKPKSEGQWVAIKNKEAVLIFNFLFFI

SEQ ID NO: 394 - protein, 523 aa, Beta vulgaris subsp. vulgaris
  misc_feature (1)..(523): Public GI no. 633172
  misc_feature (39)..(481): Pfam Name: Sugar_tr Pfam Description: Sugar (and other) transporter
  misc_feature (1)..(523): Functional Homolog of  Ceres CLONE ID no. 7894 at SEQ ID NO. 374 with e-value of 8.99E-172 and BLAST sequence identity of 67.3
MEGRNVKNGDTNNNKIVGSSLSIEKNPISPPEASSLKKLALVASIAAGVQFGWALQLSLLTPYVQLLGIPHTWAPYIWLCGPISGMIVQPTVGYYSDRCTSKFGRRSPFIAVGATLVGFAVSLIGFAADIGHATGDPNGNVPKPRAIAVFVVGFWILDVANNTLQGPCRALLADMAAGSQAKTRYANAFFSFFMALGNIGGYAGSYGRLYTVFPFTHTKACDTYCANLKSCFFISITLLIVLTILALSVVRERPFTLDEIQEEENLKNNTGGCARLPFFGQLFGALKDLPKPMLILLLVTCLNWIAWFPFLLFDTDWMGKEVYGGTVGEGKAYDMGVHAGALGLMINSVVLGIMSLGIEKLARLVGGVKRLWGIVNLILAVCLAMTILVTKSAEHYRATHHVPGAIGPPLPPPGVKGGALAIFAVLGIPLAITFSIPFALASIFSASSGSGQGLSLGVLNLAIVVPQMFVSVTSGPWDALFGGGNLPAFVVGAVAATASAILSFTLLPPPPPEAKIGGSMGGH

SEQ ID NO: 395 - protein, 510 aa, Asarina barclaiana
  misc_feature (1)..(510): Public GI no. 6120115
  misc_feature (28)..(123): Pfam Name: Sugar_tr Pfam Description: Sugar (and other) transporter
  misc_feature (1)..(510): Functional Homolog of  Ceres CLONE ID no. 7894 at SEQ ID NO. 374 with e-value of 5.50E-172 and BLAST sequence identity of 67.2
MENGDHRTAPAFQLQQASPPEAAPVRNIILVAAIAAGVQFGWALQLSLLTPYVQLLGIPHTWTAFIWLCGPVSGMLVQPIVGYYSDNCTLRFGRRKPFIAGGAGLVVVAVFLIGFAADIGYAAGDTLGKGTKPRATAVFVVGFWILDVANNMLQGPCRALLADLSGGNARKMSNANALYSFFMAVGNVSGYAAGSYTHLFKIFPFSKTKACDVYCANLKSCFFISVALLLCVSALALTIVRETPPPETAEAPEATKKKKIPVFGELFSALKNLPRPMWFLLLVACLNWIAWFPFLLFDTDWMGKEVYGGTVAEGKMYDRGVRAGALGLMLNPVVLGFSSLGIQAIARGVGGPKRLWGGVNFLLAVCLALTVVITKQAEHSRLYTVGADGVQILLPPVPGVKISALALSGVLGIPLAVTFSIPFALASIYSSNYGAGQGLSLGVLNLAIVIPQMVVSVASGPLDALFGGGNIPAFVMGAVAAAVSGIFAVTMLPALPADASTKNLSVGSFH

SEQ ID NO: 396 - protein, 510 aa, Plantago major
  misc_feature (1)..(510): Public GI no. 415988
  misc_feature (32)..(461): Pfam Name: MFS_1 Pfam Description: Major Facilitator Superfamily
  misc_feature (1)..(510): Functional Homolog of  Ceres CLONE ID no. 7894 at SEQ ID NO. 374 with e-value of 7.39E-177 and BLAST sequence identity of 66.2
MENSNRGVGAKTIITTTPPPEEAAPIRNIFLVAAIAAGVQFGWALQLSLLTPYVQLLGIPHKWASYIWLCGPISGMIVQPVVGYFSDNCTSRFGRRRPFIAAGAGLVGVAVVLIGFAADLGHAGGDSLGDGLKPRAIGVFVFGFWILDVANNMLQGPCRALLADLSGGNTKKMANANSFFSFFMAVGNVLGYAAGSYSRMYKVFPFSKTKACDIYCANLKSCFIISITLLITLTTLALSIVREKRHVAEEQVTAAKKGFKIPVFPELFGALKDLPRPMWVLLLVTALNWIAWFGFLLFDTDWMGREVYGETQQHKAPELAVIYNKGVSAGALGLMLNSIVLGFASLGVQYMARALGGVKRLWGVVNFILAICLCMTIVITKVASHHRPYSNGVLQTPESSVKIGALVVFSALGIPLAITFSVPFALASIYSTTTGSGQGLSLGVLNLAIVIPQMIVSVASGPWDAMFGGGNLPAFVVGAVAAAASGIFAFTMLPSPPAESIKNLSVAGGH

SEQ ID NO: 397 - DNA, 1014 bp, Arabidopsis thaliana
  misc_feature (1)..(1014): Ceres CLONE ID no. 8161
  misc_feature (1)..(1014): Ceres SEED LINE: ME00914
  misc_feature: Encodes the peptide sequence given in SEQ ID no. 398
ctctctctcttaaagctctcttctttggctctttcgaagaagaaccatttttatttcctaagagagacgacggagttcttttctaaagcaccggagaggaggagaagcaacgatggagaatgattgcacggtgaatattgtctctctggagaaggatcgcgatgtttcggaggcgtcggctgaatctcagagcgagtcgactctttcgaactcgctcgattccggtgttacggctgagacctctcgttctgatgctgattccaaactggatgaatgtactgcttggacgaatgagaaacacaactcatatcttgattatttagagagctcgtttgttaggcaattatactccttgcttggaggtgggactcagagactttctagaactcgtgatgtgcagtctaactctcataaatcagctgatcagtttaccgtcctacaaaatggttgctggcagaaggttaactttggaaagaaacaatcttgtttggagacttcatctgagtttcgttttcacagaaattcattgagaaataagcctgaaaattccaacggaaattacaccatgggaactactgtccaaggagatgtgttatgtcatgacgaaaccaaacactcagaggcgtcagggcagaatttcagagaagaagaagaagaagaagagaagggagaggtgagcaaaaaacgagaaagagaagcaaataacgatgatagttcattgaaggaggatcaggttgtgccggtaaggatggtgaagcccagaacgtgaaagcattaggaagtgtagatgaaatactatgaatagagataaagaaatagaagaaggtgtggttacgaatgtggagagggttttgtttgttgtatagcgtgaggctaaagagagccttccttataaagggatccaatgggatatggaaataggattggtgtttgttttcgttaaattttgtctaatgttaactaggggaaaagttatctgatagtattagcatcttatggcaattttattctttt

SEQ ID NO: 398 - protein, 218 aa, Arabidopsis thaliana
  misc_feature (1)..(218): Ceres CLONE ID no. 8161
  misc_feature (1)..(218): Ceres SEED LINE: ME00914
MENDCTVNIVSLEKDRDVSEASAESQSESTLSNSLDSGVTAETSRSDADSKLDECTAWTNEKHNSYLDYLESSFVRQLYSLLGGGTQRLSRTRDVQSNSHKSADQFTVLQNGCWQKVNFGKKQSCLETSSEFRFHRNSLRNKPENSNGNYTMGTTVQGDVLCHDETKHSEASGQNFREEEEEEEKGEVSKKREREANNDDSSLKEDQVVPVRMVKPRT

SEQ ID NO: 399 - DNA, 1303 bp, Zea mays
  misc_feature (1)..(1303): Ceres CLONE ID no. 1560908
  misc_feature: Encodes the peptide sequence at SEQ ID No. 82
aacggcacggccacagctgactgactcatcctgcgttgtccgataatcatggctagagctccgctgctcctcgcgctgctgtgcgcgtgcgccgccgccgccggctccgccaatgcggcggcggggaggaagatggtcggcgtgtacgagctcaaggcgggcgatttctccgtcggcgtcaccaactggggcgccaccatcacctccgttgtgctgccggactccaaaggggattttgctgacgtcgtgcttggctacgacaccattggaggatacgtgagtggtaaaagctacttcggagcgcttgtcggacgagtggccaacaggatcgccaacgcgcgcttcgtgctcgacggaaaggcttaccatcttttcaagaacgacggcaacaacacgcttcatggtggccatagggggttcagtcaggttgtatggacggttaaagagttcgtcggtggcggtgactcaccctacatcacgttgtactaccacagcttcgatggagaacaaggtttcccaggcgacctggacgtgtacgtgacgtaccagctggcggccccctacgtgctgcgggtgcacatgaacgcgacggccgtgaacaaggcgaccccggtgaacctggcgcagcacacgtactggaacctgggcgggcagggcagcggcgacgtcctccgcaacacggtgcagctgttcgcgtcccggtacacgcccgtgggcggcggcctcatcccgacgggcgcggtggcgcccgtggccggcacgccctacgacttcctcgcgccggccgcggtgggctcgcgcatccgccaggtctccggcggcaaggccggcgtctacggctacgacaccaactacgccgtggacggggagcccggggcgctgcggaaggtggccgtcgtccgggacggcgcgtccggccgggcgctggagctgtgggccaaccagcctggggtgcagttctacacgggcaacttcctccaggacgtcaaggggaagggcggcaaggtgtaccagcagtacggcgcgctgtgcctcgagacgcaggggttcccggacgccgtcaaccaccccgatttcccctcccagatcgtcaggccggggcaggtgtacaagcacgacatggtgttcaagttctccttctagccgctctgtataggcaacaccctggtccctggctggctaatcaatctactagtacctgttatgattgtcactggcaaagtggcaactgggccttattgggactggagacacacgttacatgattccaaaaaaaaaaaaaaaaaaaaaaaaaaaaaaaaaa

SEQ ID NO: 400 - DNA, 1304 bp, Zea mays
  misc_feature (1)..(1304): Ceres CLONE ID no. 399052
  misc_feature: Encodes the peptide sequence at SEQ ID No. 84
acggcacggccacagctgactgactcctcctgcgttggctgataatcatggctagagctccgctgctcctcgcgctactgtgcgcgtgcgccgccaatgcggcggggaggaagatggtcggcgtgtacgagctcaaggcgggcgatttctccgtcggcgtcaccaactggggcgccaccatcacctccgttgtgctgccggactccaaaggggatttgtctgacgtcgtgcttggctacgacaccattggaggatacgtgagtggtaaaagctacttcggagcgcttgtcggacgagtggccaacaggatcgccaacgcgcgcttcgtgctcgacggaaaggcttaccatcttttcaagaacgatggcaacaacacgcttcatggtggccatagggggttcagtcaggttgtatggacggttaaagagttcgtcggtggcggtgactcgccctacatcacgttgtactaccacagcttcgatggagaacaaggtttcccaggcgacctggacgtgtacgtgacgtaccagctggcggccccctacgtgctgcgggtgcacatgaacgcgacggccgtgaacaaggcgaccccggtgaacctggcgcagcacacgtactggaacctgggcgggcagggcagcggcgacgtcctccgcaacacggtgcagctgttcgcgtcccggtacacgcccgtgggcggcggcctcatcccgacgggcgcggtggcgcccgtggccggcacgccctacgacttcctcgcgccggccgcggtgggctcgcgcatccgccaggtctccggcggcaaggccggcgtctacggctacgacaccaactacgccgtggacggggagcccggcgcgctgcggaaggtggccgtcgtccgggacggcgcgtccggccgggcgctggagctgtgggccaaccagcctggggtgcagttctacacgggcaacttcctccaggacgtcaaggggaagggcggcaaggtgtaccagcagtacggcgcgctgtgcctcgagacgcaggggttcccggacgccgtcaaccaccctaatttcccctcccagatcgtcaggccggggcaggtgtacaagcacgacatggtgttcaagttctccttctagctgatctgtataggcaacaccctggtccctggctaatcaatctactagtacctgttatgattgccactggcaaagtggcaactgggccttattgggactggagagacacgttacatgattccaagtcaatttgttttgcggaccgtaattaatgtttatcgcaaagattatgtattaacc

SEQ ID NO: 401 - DNA, 1355 bp, Triticum aestivum
  misc_feature (1)..(1355): Ceres CLONE ID no. 1314177
  misc_feature: Encodes the peptide sequence at SEQ ID No. 85
atccgcccacgagcaactggtctgcacacccacccagtggcccgcccctcctctcttcgtcttcctctcgcagcttgcagcaatggccggagcaccgctgcttcttcttctcgcggcggtgtgcctcgcgtgcttcgcccccggcgccaatgcggcggggaggaagatggtcggcgtctacgagctcagcaagggagatttctctgccaaggtcaccaactggggcgccaccgtcacctccgtcgtctttccggattccaaagggaatttgggtgatgttgtccttggctatgacaccatcggtgaatatgttaacggatccagttactttggagcgctggttggacgagtagccaacagggttgccaaggcgcgcttcgtgctcgatggaaaagtctaccacctatatgccaacgatggcaagaacgcacttcatggtggccataggggcttcagtaaggttatatggacggtgaaggaatatgtcagtggtggtgactccccacacatcacactgtactatcatagcttcgacggagaacaagggttccccggggccctggacgtgtacgtgacgtacgagctgtcgagcccgtacgtgctgagcgtgcgcatgaacgcgacggcgctggacaaggccacgccggtgaacctggcgcagcacacgtactggaacctgggcggggagggcagcggcgacgtcctgggcaacacggtccagctcttcgcggcccggtacacgcccgtggacgccacgctcatcccgacggggcagctggcgcccgtggccggcacgccctacgacctccgggcgccgaccgccgtgcgcgagcacctccgccaggtcgtcggcggcagcagcaacggcagcaccatctacggctacgacatcaactacgtggtcgacggcgacgcgcgcgcgctgcgcaaggtggcggccgtccgggacggcgcgtccgggcgcgcgctggagctgtgggcggaccagcccggcgtgcagttctacaccggcaacttcctccaggacgtcaaggggaagggcggcagcgtgtacgggcagtacggcgcgctgtgcctcgagacgcaggggttccccgacgccgtcaaccacccggagttcccgtcgcagatcgtgaggcctggccaggcggcgtacaagcatgacatggtgttcaagttctccttctagctagagctggtcgacccaaggatgggcatcgctgtttaggcaacttcagtcgagtgaccgttctcctggatgttgtgactcttttggtgtcggtacttggtaggaagatcagcaataatactctcgggtacgagtctatttttgcactgcaaaaaaaaaaaaaaaa

SEQ ID NO: 402 - DNA, 1330 bp, Glycine max
  misc_feature (1)..(1330): Ceres CLONE ID no. 1371577
  misc_feature: Encodes the peptide sequence at SEQ ID No. 87
ataaccatcaagcagtagtggccccttcttccagctcttcttggctgctaaggtgacactctctgtggaatagatacacctcgcgatgaaaatggcgagggccctgcttgtcgcccttcttcttgtctcgtgctttgtggcgcttggcctgtccggccgcgccgatgcggcggccgagaggaagaccgtcggtgtctacgagctcaacaagggggatttctccatcaaggtcaccaactggggtgccaccctcatgtccgtgattctcctcgactcgagaggaaactttggggatgtgatcctgggctacgatacggttgctgaatacatgaatggcaccgcctacttcggagggctgatcggccgcgtcgccaacagaatcgccaacgcccggttcacgctggacgggaaaacctaccggctggttcccaacgacggcaacaacacgctgcacggtggtcaccggggattcgacaaggtcgtgtggacggtgaaggagcatgtcgccggcggcagctcgcccttcatcactctctactaccatagcttcgacggagagcaagggtttccgggcgacgtggacgtgcacgtgacgtaccaactctcgagcccgcacgtgctgagcgtgcgcatgaacgcgacggcacggggcaaggccaccccagtgaacctggcgcaccacgcctactggaacctcggcggcgacggcagcggcaacgtccttggcgaggaggtccgcctcttcgcctcccggtacacgcctgtggatgcctcgctcatcccgacgggccgcatggcgtccgtggctggcacaccctacgacttccgcacgccggccgccgtgggctcgcgcatcggcggcctcctgagccggggcgtcaacgggtacgacatcaactacgtcgtcgacggcaggggcctgcgcccggtagcggtcgtccgggacggcgcgtccggcagggcgatggagctgtgggcggaccagcccggggtgcagttctacacggccaacgggctcagcggggtgagggggaagggtggcaaggtctacggccactacggcgcgctctgcctggagacgcaggggttccccgacgccgtgaaccgcccgagcttcccgtcgcagatcgtccggccggggaaggtgtacaagcatgacatggtgttcaagttctccttctagtaactactagctggtggtatccaaggtcccgtggttggtcgtttgtcaggcaacacagccactcttgtgttttgtgtactgtgtgaatttgatcggctgagcttcaaggggaggaataaaagcatgttgctggttcaaggttttttc

SEQ ID NO: 403 - DNA, 1402 bp, Triticum aestivum
  misc_feature (1)..(1402): Ceres CLONE ID no. 639223
  misc_feature: Encodes the peptide sequence at SEQ ID No. 91
atagcctggttcagtgcgtgcctgcatcttctcagccgtcctcttcttccttcctgctactggtaacctgcgagagggcgttggcctccaatggcgagggctcctgtgtttccggcgctcctgtgcctcgcggtcctcgcgctggccggcggcgccgacgcgaggaagatggtcggcgtgtacgagctcaagagaggggatttctccgtcaagatgaccaactggggcgccaccatcatgtcgatcctcgtccctgattccaaagggaatttggctgatgttgtgctgggcatggacaccctcgctgagtatgttaatgatacctcttactttgggccgctgaatgggagggtggcgcagagaatggccaggggccgcttcgtcctcgacggcaaagtgtaccatacctacatcaacgacggaaagaacgcaattcatggtggcaaaagggggttcagcaaggtcatatggacggtgaaggagtacgtcgccggcggcgactccccatacatcaccatgtactaccgcagcttcgacggagagcaaggattccccggagacctggacgtgtacgcgacgtaccagctgacgggcccgtacgagctgagcatccgcacgaacgcgacggcgctgaacaaggcgacgccggtgaacttcctgcagcacgtgtacctgaacctgggcggggagggcagcggcgatatcctgggccacacgctccagctctccgcgtcccggtacaccccgctggacgtggagatgctcccgtcgtcgggccgcgtcgaccccgtggccggcacgagctacgacttccgcacgccgacgcccatcggcgcgcgcatccggcaggtcatgggcggcaaagtctacgggtacgacatcaactacgtcatcgacggggaaggcatgcggaaggtggcggcggtccgggacggcaagtccgggcgcgcgctggagctgtgggccaaccagccggccatgcagctctacaccggaaacttcctgaaccacaccaaggggaagggcggcaagctgtacgagcagtacggcgggttttgccttgagacccaggcgtacccggacgccgtgaaccaccccgagttcccgtcggtgacggtgaggcccggccaggtgtacaagcacgacatgcgcttcacgttctccttctagctaaggctggaatgaatatggctgcggtacggtagtaccaccattggttaatggatcgtagatgtgttccctctggatttggaggtggcgcgattcgtgggactggatgcggttatgccgtgagcccagagcggctacggtgtttgaaaaataaaatcatgcgtttgtgcagtgcaaatgatccgctcaataagaaaatggaagaaaatggtgtgcaaaaaaaaaaaaaaaa

SEQ ID NO: 404 - DNA, 440 bp, Brassica napus
  misc_feature (1)..(440): Ceres CLONE ID no. 953928
  misc_feature: Encodes the peptide sequence at SEQ ID No. 97
acttctttcattgcctgtcttcagaaaccctttttagctttccgccgcctcctgcgagatccccatcaacttccgcaaaaatgaaggttgtcgccgcgttcttactcgccgttctgagcggaaaggcttgcccaaccagtgcggatatcaaagttatcctcaattcagttggttgtgaaacagaggattctcagattgagcttttgttgaaggaagtcaatgggaaagatgtggctgagttgattgctgttggaagggagaagttagcttcagtacccagcggtggtggtggtgttgccatggcttctgctccatctgctggtggtggtggaggtgctgcccctgctgaggacaagaaggaagagaagaaagaggagaaggaagaatccgatgatgacatgggtttcagcctgttcgagtagaggctctgtcatctgatt

SEQ ID NO: 405 - DNA, 625 bp, Glycine max
  misc_feature (1)..(625): Ceres CLONE ID no. 524682
  misc_feature: Encodes the peptide sequence at SEQ ID No. 98
actacttcaaaaagaacagcgccatagcataacccttcgaagtcgccgtttgttttcttttcgttcgcatcttctctctctctcagaaagatgaaggtggtcgccgcgtatttgctcgccgtcctcggtggcaacaacagcccctccgccgatgtcatcaaggaaatccttggctccgttggagtagaagcagatgaagataggattgaatcgtttttgtctgaagttaagggtaaggatatagttgagcttattgctgccggtagggaaaagttggccacggttccttctggttgtggtggtgccgttgccgtcgccgcagctcctgggggaggtgctgctgctgctgctcctgctgctgaggcaaagaaggaggaaaaggtggaggagaaagaggaatctgatgatgatatgggtttcagtctcttcgattaattggtgtagtctattcagcttttttgttcagaacatattyttaattaacactagagcatgagtttgtcaaagttttgttctaaggagtaatttactgtgttttttaatatcaatgaccaaccaagttggatgaatttggtttgatattttagtgtcttgatgttatggaatttcattttggtaaatytcg

SEQ ID NO: 406 - DNA, 553 bp, Parthenium argentatum
  misc_feature (1)..(553): Ceres CLONE ID no. 1609735
  misc_feature: Encodes the peptide sequence at SEQ ID No. 99
aactcaccacacaaatcaaccaaatcacactgcggcagtaacacttttcacagaaaaaaatgaaggttgttgctgcatatttgttggctttgttgggaggcaacacatctccatctgctgaggatttgaagaatattctcggatcagttggagctgattgcgatgatgataaaatcgaattgctgttgtcagaggttaagggtaaagatatcactgaactaattgcgtctggtagggagaagttggcttcagttccttcaggaggtggtggtgttgctgttgctgctgcagctggtggtggtggcgctgcacccgcagctgccgctgctgagtcgaagaaagaagaaaaggtcgaagagaaagaagagtcggacgatgacatgggattcagtttgtttgactgaggatacttggaatcaagcatttcttgtttcatcaatatttattttcttagtgttgtgaccaaattttgaattttgtatgaccttgcaaaagtttttcatgacatttagagtctaaagtgtttttatttcaaaaaaaaaaaaaaaaaaaa

SEQ ID NO: 407 - DNA, 590 bp, Brassica napus
  misc_feature (1)..(590): Ceres CLONE ID no. 949174
  misc_feature: Encodes the peptide sequence at SEQ ID No. 100
aaaaaccctaactgtatataaataaaccctcacatcctcttcgtcgccgtctaggaaaactctacagctcctcctccgatatccattcaataacttccgcaaaaatgaaggttgtcgctgcgttcttactcgccgttttgagcggaaaagcttctccaaccagtgccgatatcaaggacatccttggatcagttggggctgaaaccgaagatgctcagattgagcttttgttgaaggaagttaaagggaaagactgtgctgagctaattgctctcggaagggagaagctagcttctgtcccgtgcggcggtggtggtgttgcgatggcttctgctccatctgctggcggcggaggaggtgctgctcctgctgaggaggccaagaaagaagagaagaaagaagagaaggaagaatccgatgatgacatgggtttcagtcttttcgagtaagcgggtttacttggcttctatttttgtcttcaccttttgaaattttttgttgttgtttcttagtttgtactcgatcagtgtcttaacattcctgaaattctcaagagatttttacgcaaatataatcgtcattgttatwtc

SEQ ID NO: 408 - DNA, 483 bp, Brassica napus
  misc_feature (1)..(483): Ceres CLONE ID no. 1299820
  misc_feature: Encodes the peptide sequence at SEQ ID No. 101
aaaacgccctaaaaccctaactgtatataaataaaccactttcctttcattttctcttcgtcgccgtctacgaaaattcaataacttccgcaaaaatgaaggttgtcgctgcgttcttactcgccgttttgagcgggaaagcttctccaaccagtgccgatatcaaggacatccttggatcagttggggctgaaaccgaagatgctcagattgagattttgttgaaggaagttaaagggaaagactgtgctgagctaattgctgtcggaagggagaagctagcttctgtcccgtgcggcggtggtggtgttgcgatggcttctgctccatctgctggcggtggaggaggtgctgctcctgcggctgaggccaagaaggaagagaagaaagaagagaaggaagaatccgatgatgacatgggtttcagtctattcgagtaagccggtatacttggcttttatttttgtcttcaccttttgaaat

SEQ ID NO: 409 - DNA, 587 bp, Zea mays
  misc_feature (1)..(587): Ceres CLONE ID no. 426736
  misc_feature: Encodes the peptide sequence at SEQ ID No. 103
acttcttcatcgccgtctgcacaaaaccctaatctcacaatctcctacgagatccatcagtctccacgaaaatgaaggttgttgccgcatactkgctcgctgttttgagcggaaaagcttcaccaaccagtgccgatatcaagactatccttggatcagttggtgctgagacagaggattctcagattgagcttttgttgaaggaagtgaaaggaaaagatttggctgagttgattgctgctggaagggagaagttagcttcagtgccgtctggtggcggaggtggtgttgcggttgcttctgctacatctggaggtggaggaggtggtggtgctcctgctgctgagtccaagaaagaagagaagaaggaagaaaaggaagaatccgatgatgacatgggtttcagtctattcgagtaagctggtagtagcatgaaaagtcccggttttgttgtcctcttttaatattgkaaccttttgaaatctatatgttgttgttgtttagttttgtattcgatcatctttttwsmcccattgctgaaaattctcaagagtttttgacccgaatgtcatttgcactttgttgtt

SEQ ID NO: 410 - DNA, 461 bp, Brassica napus
  misc_feature (1)..(461): Ceres CLONE ID no. 1094375
  misc_feature: Encodes the peptide sequence at SEQ ID No. 104
  misc_feature (205)..(205): n is a, c, t, g, unknown, or other
aatcctttcatwgccgtcttcacaaacacttwagctttccgccgcctcctgcgagatccccatcaacttccgccaaaatgaaggtyrtcgccgcgttcttgctcgctgttcttagcggaaaagcttgcccaaccagtgctgacatcaaggttatcctcaattcagttggttgtgaaacagaagattcccagattgagcttttgttgaaggaagtcnatgggaaagatgtagctgagttgattgcygttggaagggagaagttggcttcagtacccagcggtggtggtggtgttgccatggcttctgctccatctgctggtggtggtggaggtgctgcccctgctgaggccaagaaggaagagaagaaagaggagaaggaagaatccgatgatgacatgggtttcagcctgttcgagtagagcgtatgcttggctgtcatctgattttgctatcattttgtt

SEQ ID NO: 411 - DNA, 591 bp, Glycine max
  misc_feature (1)..(591): Ceres CLONE ID no. 691062
  misc_feature: Encodes the peptide sequence at SEQ ID No. 105
cacgagaccatcgaagtcgccgtttgttttcttttcgttcgcatcttctctctctctcagaaagatgaaggtggtcgccgcgtatttgctcgccgtcctcggtggcaacaacagcccctccgccgatgtcatcaaggaaatccttggctccgttggagtagaagcagatgaagataggattgaatcgtttttgtctgaagttaagggtaaggatatagttgagcttattgctgccggtagggaaaagttggcctcggttccttctggtggtggtggtgccgttgccgtcgccgcagctcctgggggaggtgctgctgctgctgctcctgctgctgaggcaaagaaggaggaaaaggtggaggagaaagaggaatctgatgatgatatgggtttcagtctctccgattaattggtgtagtctattcagcttttttgttcagaacatattcttaattaacactagagcatgagtttgtcaaagttttgttytaaggagtaatttactgtgttttttaatatcaatgaccaaccaagttggatgaatttggtttgatattttagtgttttgatgttatggaatttcattttggt

SEQ ID NO: 412 - DNA, 551 bp, Glycine max
  misc_feature (1)..(551): Ceres CLONE ID no. 709027
  misc_feature: Encodes the peptide sequence at SEQ ID No. 113
attccgaattccagagagcaatatattcgttccgttccttctttctccgctcctcacttcgctctctcattctccattctcacttctcaaattgaatcgaacgaattcacaaaccctagttttcgaggatgggtcagatccagtactccgagaagtacttcgatgacacttacgaatatagacatgtggttcttcctcctgaagtcgcaaaactgcttcccaagaatcgtcttctctccgaaaatgagtggcgggcaattggggttcagcagagccgtggctgggttcattatgcaattcatcgccctgagccacacataatgctcttcaggaggcctttgaattatcagcagcagcaggaaaaccaggcccagcaaagcatgcttgtcaaatgaacactatctatgcaaatctgaaagtgggattacaatgttatataggttttaattttgttggtaatatggatgttatgaagaatgaagaaccctggtggaattctctttttgtggagaattttcatgtggtttcaactgtcaaaaaaaaaaaaaaaa

SEQ ID NO: 413 - DNA, 463 bp, Glycine max
  misc_feature (1)..(463): Ceres CLONE ID no. 853298
  misc_feature: Encodes the peptide sequence at SEQ ID No. 114
ctattccgaattccagagagcaatatattcgttccgttccttctttctccgctcctcacttcgctctctcattctccattctcacttctcaaattgaatcgaacgaattcacaaaccctagttttcgaggatgggtcagatccagtactccgagaagtacttcgatgacacttacgaatatagacatgtggttcttcctcctgaagtcgcaaaactgcttcccaagaatcgtcttctctccgaaaatgagtggcgggcaattggggttcagcagagccgtggctgggttcattatgcaattcatcgccctgagccacacataatgctcttcaggaggcctttgaattatcagcagcagcaggaaaaccaggcccagcaaagcatgcttgtcaaatgaacactatctatgcaaatctgaaagtgggattmmaatgttatataggttttaattttgttggtatat

SEQ ID NO: 414 - DNA, 598 bp, Glycine max
  misc_feature (1)..(598): Ceres CLONE ID no. 1417425
  misc_feature: Encodes the peptide sequence at SEQ ID No. 115
atttttcactctcaattctcatttctcagcaaattgaatcgagcgaattcacaaaccctagttttcgacgatgggtcagatccagtactccgagaagtacttcgatgacacttatgaatatagacatgtggttcttcctcctgaagtcgcaaaactgcttcccaagaatcgtcttctctccgaaaatgagtggcgagctattggggttcagcagagccgtggctgggttcactatgcaattcatcgccctgagccacacataatgcttttcaggaggccgttgaattatcagcagcagcaggaaaaccaggcccagcaaagcatgcttgtcaaatgaacactttctatgcaaatctgaaagtgggatacaatgttatataggttttaatttgttggtatgtggtggatgttatgaagaccctactgccgtggaattctctttttgtggagaattttcatgtggtttcaactgtcatttttatgttttgtggacatgatgatgtgtcatggatttttattggtgtacctctcgtgtactcttatatgcttggtggattatataatagtcattttcggttaaattctacaaaaaaaaaaa

SEQ ID NO: 415 - DNA, 629 bp, Triticum aestivum
  misc_feature (1)..(629): Ceres CLONE ID no. 1017141
  misc_feature: Encodes the peptide sequence at SEQ ID No. 120
accccaccccacctcgcccccttcccctcccccttcgccgccgcccgtctccgacgctccatcagcgccgacagccgccccctctccgctccgagagcctcgatcgagaagcggcgccggcggacatgggccagatccagtactccgagaagtacttcgacgacaccttcgagtacaggcacgtggtcctcccgccggaagtcgccaagctgctccccaagaaccgcctcctcgccgagaacgagtggcgcgcgctgggcgtgcagcagagccgcgggtgggtgcactacgccgtccaccggccggagccgcacatcatgctgttccgccgcccactcaactaccagcagcagcaggacgcggcggccgccgccgcggcgcagatgatgcccaagtgatcggccccggcgagggcagtggcgaccggggttggaactcctgaaaaccccaggcccttttcatctctaaaagggcggtcgcactggtttgtctgatcaggatctagttgtgttggtggtgtccaccatgtgttcgtggaaatgcctgggaggaacttgcagtgtgttagtctgtgttattatcctggataatcttgaatgctacctgttatgttaaaaaaaaaaaaaaaa

SEQ ID NO: 416 - DNA, 516 bp, Zea mays
  misc_feature (1)..(516): Ceres CLONE ID no. 1448636
  misc_feature: Encodes the peptide sequence at SEQ ID No. 121
accccaccccaactcgtcccctccccctcccccctcgccgccgcccgtctccgacgctccatcagcgccgacagccgcccccctctcagctccaagggcctcgatcgagaagcggcggcggtggacatgggccagatccagtactccgagaagtacttcgacgacaccttcgagtacaggcacgtggtcctcccgccggaagtcgccaagctcctccccaagaaccgcctcctcgccgagaacgagtggcgcgcgctgggcgtgcagcagagccgcgggtgggtgcactacgccgtccaccggccggagccgcacatcatgctgttccgccgcccgctcaactaccagcagcagcaggacgcggctgctgccgccgcggcgcagatgatgcccaagtgatcggccccagcgagggcagtggcgaccgggggttggaactcctgaaaaccccaggcccttttgatctctaaaagggcgatcgcactggtttgtctggtcaggatctagttgtgttgg

SEQ ID NO: 417 - DNA, 580 bp, Arabidopsis thaliana
  misc_feature (1)..(580): Ceres CLONE ID no. 1338131
  misc_feature: Encodes the peptide sequence at SEQ ID No. 125
aaaaaaaaaattcattttcgtttccgatcgcacttcttctcaagtaaatttaatagacgtttgttgggtgatttaagaagatgggtcagatccagtactccgacaaatatttcgatgatactttcgaatacaggcacgttgtacttcctccggaagttgctaagcttttacctaagaatcgtattctttcggaaagtgaatggagagccatcggagtgcagcaaagtcgtggatgggttcattacgcgattcatcgtcctgagccacatatcatgctctttaggaggcctcttaactaccagcaggagcaccaagctcagattgctaagtagaagaattatgcaaaattctccctaatctctgtttatgtctctcgtaaacgaggttttaaaatactactctgatgttttgttcctgtagttttttttattgtgttcatgaattctcttcagtggagaatcatgtgagtttggtagaacaacttttaatgttatgttaagtctggtcctttgctagactttggttggatccacgtttgaacttcttcatggttaagaatgaagacgttatttctcatgct

SEQ ID NO: 418 - DNA, 723 bp, Zea mays
  misc_feature (1)..(723): Ceres CLONE ID no. 300692
  misc_feature: Encodes the peptide sequence at SEQ ID No. 126
ccatcgccccccacaccgtctcctccacaacacgctcctcacctcgcggcgactcttgccaggcattcctccgcgaaaaacgcatccgctccaaggggagttgatcgagaagcgttggtggacatgggtcagatccagtactccgagaagtacttcgacgacacctacgagtacaggcacgtcgtcctcccgcccgaggtcgccaagctcctccccaagaaccgtctcctgtccgagaacgagtggcgcgcgatcggagtgcagcagagccgcgggtgggtgcactacgcgatccaccgcccggagccgcacatcatgctgttccgccgcccgatcaactaccagcagcagcaggaggcggctgccgcgcagatgctggccaagtgagcccctggtggccagggcggcgaccaggaacgtttaaaaccctaaccccctttccatctctaaaaggggcgtcgctgttctgttgatcaattcctctatgctgttagttggaaacttcgggtgtagttggtggatttgctggtgtgtgccttgtgttcgtggaaattcctgtgaaggaactgccatgtgttaggctgttaccatgcccattttcttaatactatgtgttgactgtgatcaagatggcactcatgcagggatgatatttaatctgtttgacgtgatctttgtaatggtgtgatctggttagtagcactgatatcatgtttaatctgc

SEQ ID NO: 419 - DNA, 557 bp, Brassica napus
  misc_feature (1)..(557): Ceres CLONE ID no. 947192
  misc_feature: Encodes the peptide sequence at SEQ ID No. 127
actttagggttctcactccaaaagcgatcgatctatctgaatcggtgaatcatcatctcgtttccgtttcaattggtagggtttttgaatcgacgagaagagatgggtcagatccagtactctgacaaatacttcgacgatactttcgagtacaggcacgtcgtgcttcctcctgacaccgctaagcttctcccgaagaatcgtcttctctccgaaaatgagtggcgtgcgataggagtgcagcagagccgtggatgggtccattacgccattcatcgtcctgagccacacatcatgctcttcaggaggactctcaattaccagcagcagcagcaggagaaccatgctcaaaacgtcctcgctaagtgattctgagttgttgtgcttgttatgtttcttgtaaacatggtttgtgaaccacctctaataactttgtgttcatgttatcttggttggagaaaaacatgcgagtgattaaactgactactttgatgttgygcattgtctggttcmccatggattatatcgtgtttcttyttctatcagcctctttgttt

SEQ ID NO: 420 - DNA, 535 bp, Zea mays
  misc_feature (1)..(535): Ceres CLONE ID no. 1465004
  misc_feature: Encodes the peptide sequence at SEQ ID No. 128
agggttcttcccactccaaaaacgatcgatctatctgaatcatatcatctccgtttcaattgctagagaagagatgggtcagatccagtactctgacaaatacttcgacgacactttcgagtacaggcacgtcgtgcttcctcctgacaccgctaagcttctcccgaagaatcgtcttctctccgaaaatgagtggcgtgcgataggagtgcagcagagccgtggatgggtccattacgccattcatcgtccagagccacacatcatgctcttcaggaggactctcaattaccagcagccgcagcagcagcaggagaaccatgctcaaaacgtgctcgctaagtgattctgagttgttgtgctacaaaaacattggctgttgttacttgttatgtttcttgtaaacattgtttgtgagccacctctaataactttgttggagttggagaaaaacttgtgagtgataaaactgactactttgatgttatgcattgtttgatataatcgtgtttcttcttcaaaaaaaaaaaaaaaa

SEQ ID NO: 421 - DNA, 366 bp, Brassica napus
  misc_feature (1)..(366): Ceres CLONE ID no. 1122958
  misc_feature: Encodes the peptide sequence at SEQ ID No. 129
actttagggttcttcccactccaaaaacgatcgatctatctgaatcatatcatctccgtttcaattgctagagaagagatgggtcagatccagtrntctgacaaatacttcgacgacactttcgagtacaggcacgtcgtgcttcctcctgacaccgctaagcttctcccgaagaatcgtcttctctccgaaaatgagtggcgtgcgataggagtgcagcagagccgtggatgggtccattacgccattcatcgtccagagccacacatcatgctcttcaggaggactctcaattaccagcagccgcagcagcagcaggagaaccatgctcaaaacgtgctcgctaagtgattctgagttgttgtg

SEQ ID NO: 422 - DNA, 454 bp, Brassica napus
  misc_feature (1)..(454): Ceres CLONE ID no. 944737
  misc_feature: Encodes the peptide sequence at SEQ ID No. 130
atcttttgtgctcagttttttataaagaggatggctcggatcgaatactctgacaaatacttcgatgatacttacgagtacaggcacgtcgtacttcctccagaggttgctaagcttctccctaagaatcgcatcctcgccgaaagtgaatggagagctataggagtgcagcaaagccgtggatgggtccactacgctattcatcgccctgagccacacatcatgctcttccggaggactctcaactaccaggctccaaatcccattcctaagtagaatttatttggtttatgtctctcgtaaacacacacactctctgtttcattcccccttgtctctttttattttattttattttatttgtgtttcatggaattctcttcagtggagaattgttcgagttgtacaagaaccacttttattattatgttcgacatcaaaaaaaaaaaaaaaa

SEQ ID NO: 423 - DNA, 731 bp, Zea mays
  misc_feature (1)..(731): Ceres CLONE ID no. 217797
  misc_feature: Encodes the peptide sequence at SEQ ID No. 131
aggagatagtataagatacgcccgttgccttctcaccccaaatcctccaatttcttgtcttctccgcgaaatcttcctctgtctgtcgtgtctttgttctggtcgtttcccgattcggtagttggcttggggatttcactgcaagtctagggattttctgtagggaagttgatcgagaagtcttggtagacatggagcagatccagtactccgagaagtacttcgacgacacctatgaatacaggcacgtcgtcctcccgcccgaggtcgccaagctcctccccaggaacatccttctctccgagaagcagtggcggttggtgggtgtgcagcagagccgcgggtgggtgcactacgcgatccaccggccggagccgcacatcatgctgttccgccgcccgatcaactaccagcagcagcaggaggaagcggctgccgcgcatgtgctgcccaagtgaagcctctgctggcgaccaggaatgttaaaaacccctagccctcttttcatctctaaaaggggcgtcgctgttgtgttgattaatccctctggctgttggttggaaacttgggatctagttgggtcgacttggtgtgtgcgtggcgctcttattgtgctgacatttaatctgtgcgatttgatctttgtgattgtgattctggttagtagcgctggaatcatggttaatgtgttctacgtgagattaaaattgtcaccacgcatttcaaagttc

SEQ ID NO: 424 - DNA, 700 bp, Glycine max
  misc_feature (1)..(700): Ceres CLONE ID no. 520185
  misc_feature: Encodes the peptide sequence at SEQ ID No. 132
aggagatagtataagatacgcccgttgccttctcaccccaaatcctccaatttcttgtcttctccgcgaaatcttcctctgtctgtcgtgtctttgttctggtcgtttcccgattcggtagttggcttggggatttcactgcaagtctagggattttctgtagggaagttgatcgagaagtcttggtagacatggcagcaratccagtactccgagaagtacttcgacgacacctatgaatacaggcacgtcgtgcctcccgcccgaggtcgccaagctcctccccaggaacatccttctctccgagaagcagtggcggttggtgggtgtgcagcagagccgcgggtgggtgcactacgcgatccaccggccggagccgcacatcatgctgttccgccgcccgatcaactaccagcagcagcaggaggaagcggctgccgcgcatgtgctgcccaagtgaagcctctgctggcgaccaggaatgttaaaaacccctagccctcttttcatctctaaaaggggcgtcgctgttgtgttgattaatccctctggctgttggttggaaacttgggatctagttgggtcgacttggtgtgtgcgtggcgctcttattgtgctgacatttaatctgtgcgatttgatctttgtgattgtgattctggttagtagcgctggaatcatggttaatgtgttctacgtg

SEQ ID NO: 425 - DNA, 628 bp, Zea mays
  misc_feature (1)..(628): Ceres CLONE ID no. 1436585
  misc_feature: Encodes the peptide sequence at SEQ ID No. 134
atgaataaaaagtataaatagcggggctttgagagggggaatggtaggagatactataaggaaagttgatcgagaagtcttggtagacatggagcagatccagtactccgagaagtactacgacgacacctatgaatacaggcacgtcgtcctcccgcccgaggtcgccaagctcctccccaggaacatccttctctccgagaagcagtggcggttggtgggtgtgcagcagagccgcgggtgggtgcactacgcgatccaccggccggagccgcacatcatgctgttccgccgcccgatcaactaccagcagcagcaggaggaagcggctgccgcgcatgtgctgcccaagtgaagcctctgctggcgaccaggaatgttaaaaacccctagccctcttttcatctctaaaaggggcgtagctgttgtgttgattaatccctctggctgttagttggaaacttgggatctagttgggtcgacttggtgtgtgcgtggcgatctgtttgtgctgacatttaatctgtgcgatgtgatctttgtgattgtgattctggttagtagcgctggaatcaggtttaatctgttctatgtgagattaaaattgtcaccaaaaaaaaaaaaaaaa

SEQ ID NO: 426 - DNA, 2007 bp, Zea mays
  misc_feature (1)..(2007): Ceres CLONE ID no. 1571117
  misc_feature: Encodes the peptide sequence at SEQ ID No. 139
aactatgacccctgctgcctttccatcttcctcgatctccctagctcgctctccaatctcccatttctctctctctctctctcgtcttcgccatccaccatccatcccgtcgtcgtgatagatggcggcagtccagccgtccgtggagatgacgacgcagcaagggccgccagccgccagctattctccggccagggatggcggcggcggcaggagcgccgaggatgaggagaaggagaaggcggcggcgatcgacaactggcttcccatcagcgcgacgcggaatgccaagtggtggtactccgccttccacaacgtcacggccatggtcggcgccggcgtgctcggcctcccctacgccatgtcccagctcggctggggtgccggcatcacgatcatgctcctgtcgtgggtgatcacgctgtacacgctgtggcagatggtggagatgcacgagatggtgccggggaagcggttcgaccggtaccacgagctggggcagcacgcgttcggggaccgcctgggcctgtggatcgtggtgccgcagcagctggtcgtcgaggtgggggtgaacatcgtgtacatggtgaccggcggcacgtcgctgcagaagttccacgacgtgctggtgtgcggcgacgcggcgtgcgagggcgggcgcaagatcaggctcacctacttcatcatgatcttcgcgtcctgccacttcgtgctggcgcagctgcccaacttcgactccatctccggcgtgtccctggccgccgccgtcatgtcgctcagctactccaccatcgcgtggggcgcgtccgtgagcaaagggcgggtccccgacgtggactacggcctcagggccaccacgccgccgggcaaggtgttcgggttcctgggcgcgctcgggaccgtggcgttcgcctacgcgggccacaacgtggtgctggagatccaggccactatcccgtccactcccgagaagccgtccaagaagcccatgtggaagggcgtcgtcgtcgcctacctcgtcgtcgcgctctgctacttccccgtctcgttcgtcggctactgggccttcggcgacagcgtcgacggcgacatcctcgtcacccttaacagacccaggtggctcatcgccctcgccaacatgatggtcgtcatccatgtcattggcagctaccagatctatgcgatgcccgtgttcgacatgatagagacggtgctggtgaagaagctgcgcttccctccaggcctcacgctccgtctcattgcccgtactgtctacgttgcgttcacaatgttcatagccatcacgtttcccttcttcgacgggctgctcagcttcttcggcggattcgcgttcgcgcccacaacctatttccttccatgcatcatgtggctcgcaatctacaagcccaaacggttcagcctctcatggttcaccaactggatctgcatcatccttggagtgcttctgatggtgctggcgccgattggagggctccggcagatcattatcagcgccaagacatacaagttttaccagtaaacattgcacaattatcgtgcaaaaaacaacgcaaaccccttgcttcaccagtaactgacagacaagtcttgttaggccatatataccatgttacgatcagctgacacaggttctggattttgttccatgagggcttccaactccttgtttaatttggcacgacaaaaagctcgcaccgggtgctctaatcggcggccgattacagcgtccagtgcgagttctttgccgtgccaaaattgaaagggggtcggctcggatgccggggcatgcatacaggacctagaacccgtttcggttgatgagaatgttcctggcatgtaatgcttcccttgttggttgtggtctaacctaggagtttgctttgagtggatctttgtacaattgtacgtgtatatgatgtttttttcccttcttcatacttgtttacattattcaggggaattggatcttaaaaaaaaaaaaaaaaa

SEQ ID NO: 427 - DNA, 1564 bp, Zea mays
  misc_feature (1)..(1564): Ceres CLONE ID no. 424395
  misc_feature: Encodes the peptide sequence at SEQ ID No. 140
cccagacccagagcttctcttctcaaaagatgcaggagcaggacgtggacgatggcggcggcaggacgacccagcagcaggagaagtcgatcgacgactggctccctatcaactcctccaggaaggccaagtggtggtactccgccttccacaatgtcaccgccatggtcggcgccggcgtgctcggcctcccctacgccatgtccgagcttggctggggccctggcatcgcggtgatgatcctgtcgtggataatcaccctatacacgctatggcagatggtggagatgcacgagatggtgcctgggaagcggttcgaccggtaccacgagctcgggcagcacgtcttcggcgacaggctgggcctctggatcgtggtgccgcagcagctggcagtagaggtgagcctgaacatcatctacatggtcaccggcggccagtccctcaagaagttccacgacgtcatctgcgacggcggcaggtgcggcggcgacttgaagctctcctacttcatcatgatcttcgcctccgtccacctggtcctctcccagctccccaacttcaactccatctccgccgtgtcgctcgccgccgccgtcatgtcgctcagttactccaccattgcgtggggcgcgtcgctgcacagagggaggagagaggacgtggactaccacctgcgcgccacgaccaccccagggaaggtgttcggcttcctgggaggcctaggggacgtggcgttcgcctactcggggcacaacgtggtgctggagatccaggccaccatcccgtccacgccggacaagccgtccaagaaggccatgtggaagggcgcctttgtcgcctacgtcgtcgtcgccatctgctacttccccgtcacgttcgtcgggtactgggccttcggcagcggcgtcgacgagaacatcctcatcacgctctccaagcccaagtggctcattgccctcgccaacatgatggtcgtcgtccatgtcattggcagttaccaggtttatgccatgccggtgtttgacatgatagagacggtgctggtcaagaaaatgaggttcgctccgagcctcacgctccgtcttattgcccggagcgtctatgttgcgttcacaatgtttctaggcatcactttccccttcttcggtggattgctcagtttcttcggcggattagccttcgcaccgacaacttattttcttccctgcatcatgtggctcaaggtttacaagcccaaacggttcggcctttcatggttcatcaactggatctgcatcgttattggagtgctgctgttgattctgggtccgataggagggctccggcagatcattttgtcagccaccacatacaaattctaccagtaaaatcgatcaactggagtcgtatggcgtggctgttttgttagcattacatttcttagggtggattggcttttaatgtacacgagcgagtgagattgatgctagtagctcctaggagtatatatatttctatcatccacagagcttaatgtatcttgtagttgggacattaaaagagcaagtaggctttactcgct

SEQ ID NO: 428 - DNA, 1644 bp, Arabidopsis thaliana
  misc_feature (1)..(1644): Ceres CLONE ID no. 1002421
  misc_feature: Encodes the peptide sequence at SEQ ID No. 147
atgaggagctttatatatttagcacaatatctttcagaagtgtgaggccttgttaattaagctcttcttctctatctctctctctccctctcaacctctcaccatggtagctcaagctcctcatgatgatcatcaggatgatgagaaattagcagcagcgagacaaaaagagatcgaagattggttaccaattacttcatcaagaaatgcaaagtggtggtactctgcttttcacaatgtcaccgccatggtcggtgccggagttcttggactcccttacgccatgtctcagctcggatggggaccgggaattgcagtgttggttttgtcatgggtcataacactatacacattatggcaaatggtggaaatgcatgaaatggttcctggaaagcgttttgatcgttaccatgagctcggacaacacgcgtttggagaaaaactcggtctttatatcgttgtgccgcaacaattgatcgttgaaatcggtgtttgcatcgtttatatggtcactggaggcaaatctttaaagaaatttcatgagcttgtttgtgatgattgtaaaccaatcaagcttacttatttcatcatgatctttgcttcggttcacttcgtcctctctcatcttcctaatttcaattccatctccggcgtttctcttgctgctgccgttatgtctctcagctactcaacaatcgcatgggcatcatcagcaagcaaaggtgttcaagaagacgttcaatacggttacaaagcgaaaacaacagccggtacggttttcaatttcttcagcggtttaggtgatgtggcatttgcttacgcgggtcataatgtggtccttgagatccaagcaactatcccttcaacgcctgagaaaccctcaaaaggtcccatgtggagaggagtcatcgttgcttacatcgtcgtagcgctctgttatttccccgtggctcgttggatactacattttcgggaacggagtcgaagataatattctcatgtcacttaagaaaccggcgtggttaatcgccacggcgaacatcttcgtcgtgatccatgtcattggtagttaccagatatatgcaatgccggtatttgatatgatggagactttattggtcaagaagctaaatttcagaccaaccacaactcttcggttctttgtccgtaatttctacgttgctgcaactatgtttgttggtatgacgtttccgttcttcggtgggcttttggcgttctttggtggattcgcgtttgccccaaccacatacttcctcccttgcgtcatttggttagccatctacaaacccaagaaatacagcttgtcttggtgggccaactgggtatgcatcgtgtttggtcttttcttgatggtcctatcgccaattggagggctaaggacaatcgttattcaagcaaaaggatacaagttttactcataaacgctatgtaattccactaattaagaaacatatctttatattaatatatgtgtgaagaagtttttaagagatcaacacgagacatttatagaagaatcaatggtctggtctgaatctaaatgtagcttttagggtttgtattttcgtgtgtgttatatatattatataaaacaataatattttgctcaaaaaaaaaaaaaaa

SEQ ID NO: 429 - DNA, 1193 bp, Glycine max
  misc_feature (1)..(1193): Ceres CLONE ID no. 1121512
  misc_feature: Encodes the peptide sequence at SEQ ID No. 157
aactcttgccactgcttttatctatcttctccatcggcaacaccttgcggaagataaaaaggatcgattcttcaatcaagaccagaaaaaaaaaagagcacgtacgtcacgttagactctgtatatcctgtgctgtgtcccattcggtacgcaagcctcaaaatatacatactccttcattttttcttcttctctttatggcggaaatccccaagttggatttgtcatcttcttgttttgacaatggagagcctttggattcggaacagaagagccagaaaatttttgtttcggatcacataaacgcatttcaatacgcagacgagaaagccgatagctttgtgattgacatggatgccttctcttccggccacaacaaagatgccaccaatgctaattcgagaattacgttgcagaggagtctttccaggaagggatctcagcgtctgggtgactggaagctgaataacaatgctacactttatgataaggataccgttcccgccatatgctctccaaaaggkacacttgttgggcctttcacgcccgaaaagccagcggggatggcagtagggcccatgggtcattccatgaacccacacgtccataatctaacagccgacaacatccccacagagagcaaatgtagtataactcggagaaatagttttagacgaccttcttcatgggccattgatcctaaaagggttctccttttctttgccaccttgtcaagcatgggaacaatgttgctgatatacttcactctgacaatcagtaagcaaagtgcagaagaatatggagggtgattggaagcattgactgaaggttttggattatgataacaaaaaaagaaaagaaaaaggacatgcattaattctggagcaaaacttacaagttaattagaagaagacaaccctgcagcaggagtagcaaagcaaaagctaaccaaatttccgccagcctgatgtcaaaatcagttaaaatcatctctttggcaactgcaagaggtaaatacaaagacacaatgtagtactatgacagagatcaggaagaaatcttccattatgtttttttttttttcatgtaaatggaagaaaaacaaacgatcacatggaggacattgccctttagtttatatgttgcgtgatcgcagggtttagtggaggatggatcataaatcaccttttgcc

SEQ ID NO: 430 - DNA, 1324 bp, Triticum aestivum
  misc_feature (1)..(1324): Ceres CLONE ID no. 754061
  misc_feature: Encodes the peptide sequence at SEQ ID No. 162
gaaaaagagaaatctatctatctattctcaaaaaataaagaagagagaaatctatctatatctatctgcagcgtacgcggccgctgccgctggccaccacccgctccttgcccgcgtctctcttcctctgtatatataaatgctcagggcctccctgatccccaaatgtcccaggccggcccctctctccccactccttccttaaaccccccataacccttgttcctttcccttccagtctcgctcctcttctccaggtctctccggctccaaacacaaacggcgaggaggcgccggagcgagctgccgtcgcggcccgccactgccggtggagtcgagtcccgaagctggagaagtggagatagagcttccgcaccctctcgccggcgttgatcagagtgcctctgcagggaaaaaggggcgaacgtacgcgtagccagcagcggtagcgggggaggaagatgatgatgactcaagtggccaaccacagcaagaggaaccacaccgacggctacttcagcgggaagcagcagcagcagcagcagcaggtcggcgccgccaccgccaccagcagcggctcggaggagttcggccgcatggggtccaagaagccgaggagcgccagtcccaggggcagcggcggccccatttctcccagggagaagaaggacaaggtcggcgagagagtggcggcgctgcagcagctcgtgtcgccatttgggaagacggacacggcttctgttcttcaggaggcgtcgggctacatcaagttcctgcaccagcagctcgaggttcttagctccccgtacatgcgccctcctccggcgcccggcgccgagcctgaggaccccgagcactacagcctgcggaaccgcggcctgtgcctggtgccggtggagcagacgctgcagctgacccagagcaacggggccgacctctgggcgccggcgaacaccagcaggcgcacctgaagcgaagcccgaggcaggcctcgacggcggcgatggccgcactgcgtggcaggggtagaattccggtgcaagcgcgcgcatgcgcatggctgacccaattcggtcaatctcctaacacaatcgtttcgtttcgtttcgtttccgtgaacctcaatcagcagaccctgtgctggcgccggtagtatgtaatgtgtaatcgtcgtgtatagcgagacgacgcaccgccgatcgatcgatcgtggtcgagtcgttgcgtcagtgactatgtgcatgtggtttaacatggtagcgacctgttgctgtcgccgactaatcatcaaaatcagcagttccattcaaaaaaaaaaaaaaaa

SEQ ID NO: 431 - DNA, 1246 bp, Triticum aestivum
  misc_feature (1)..(1246): Ceres CLONE ID no. 1329861
  misc_feature: Encodes the peptide sequence at SEQ ID No. 163
aaaaatgtcccaggccggcccctctctccccactccttccttaaaccccccataagccttgttcctttcccttctctctagctactcttgcagcctcgctcctcttctccagcaggcctctccggctccaaacacgaacggtgaggaggcgccggagcaagctgccgtcgcggcgcgccactgccggtggagtcgagtctcgaagccggagtagtggagatagagcttctgccccctctcggcggcgttgatcctctgcagcaggaaaaaaggggcgaacgtacgcgtagccagcagcagtagcgggggaggaagatgatgatgactcaagtggccaaccacagcaagaggaaccacaccgacagctacttcagcgggaagcagcagcagcagcagcagcaggccggcgccaccaccaccagcggcggctcggaggagttcgcgggcatggggtccaagaagccgaggaacgccagcccccggggcagcggcggccccatttctcccaaggagaagaaggacaaggtcggcgagagagtggcggcgctgcagcagctcgtgtcgccatttgggaagacggacacagcttctgttcttcaggaggcctcgggctacatcaagttcctgcaccagcagctcgaggttcttagctccccgtacatgcgccctcctccggcgcccggcgccgagcctgaggaccccgaccactacagcctgcggaaccgcggcctgtgcctggtgccggtagagcagacgctgcagctgacccagagcaacggggccgacctctgggcgccggcgaacaccaccagacgcacctgaagtgaagcccgaggcaggcctcgacggcggcgatggccgcactgcgtggcaggggtagaattccggtgcaagcgcgcgcatgcgcatggctgacccaattcggtcaatctcctaacacaatcgtttcgtttcgtttatgtgaacctcctcaacaggccctgtgctggcgccggtagtatgtaatgtgtaatcgtcgtgtatagcgagacgacgtaccgccgatcgatggatcgatcggtccccgtggtcgttgcgtgggtgactctgtggtttaacattggtagcgacctgttgctgtcgccgactaatcatcaaaagcagcagtttcattcatgcccgtccgtgctcatcaacccttgtagtactagagagtatcaacatgcggtgcatgcatttgtgcggggtgcgaaaaaaaaaaaaaaaa

SEQ ID NO: 432 - DNA, 1092 bp, Glycine max
  misc_feature (1)..(1092): Ceres CLONE ID no. 537752
  misc_feature: Encodes the peptide sequence at SEQ ID No. 164
tcttctttttccttctttctccacaagaagccacacacacctctgtttctttctctgctccacactttctcttcctccattattgagcttccactagttttttttcccctttctttcttccaaggacttaattgcactgcttaaagtctcaagctttacaacttttggaagatacccattttttgcagccatcacttacttgcccaagaagagaggggctttcttttggtttcaaccattttctgcttttggcttcaaaaggaacatcatagatgatagccagctccttctgcaatgctgattctatgttttcaagagaagaggggatagatgttagaaagatgatggaacataaaaggagaccctgctctgttgaccaaagcagttatacttctattgcatctaaaaggcaaaaggctgatttatcgatcagcactaaggagaggaaggaaaagattggcgaacgaattgttgctcttcagcagcttgtttcaccatatgggaagacagatacatcttctgttctaaaggaggcgatggaatacataggattccttcataaacaagttaagctgcttagtgctccataccttgaaagttcaccagcagccaagatgcagggtgtggagccatgcagcctgaggagtagaggcttatgtcttgttcctgtgtcagttactattggagttgctgagagcaatggtgcagatatctgggcccccattaagactactacttctcctaaatttgagaaggatgtctcccaatttcattgacaaattttctcatctttgcagcctaaaggttgctaaagttgctaaactagcatgaaaattactatgatgatacatctagatggaatcatagtagctatatatatatatataatagttaaagcattaaaaaaaaaaactctagtcaaaaagctgtcccacacctcttagattttaaacgggtgatgggggtaagcttccaattagccatatgtgcccttaattaattaattccatgtgctgattattaagtgtatatttgaaaaattctagttgtataatgtttccatgaactgattagtttaatcaaagtcgtttc

SEQ ID NO: 433 - DNA, 1127 bp, Triticum aestivum
  misc_feature (1)..(1127): Ceres CLONE ID no. 1322549
  misc_feature: Encodes the peptide sequence at SEQ ID No. 165
aaatgtccccgggcggcccctcccttcccactccttccttaaacccccataagccttgttcctttcccttctctctagctactcttgcagtcccgctcctcttctccaggcctctccggctccaaacacagacggcgaggagcgccggagctagctgccgtcgcggcgcgccagtgccagtggagtcgagtatcgaagctggagaagtggagatagagcttccgccccctctcggcgttgttgatcaaactgcctctgcagcaggaaaaaaggggcgaacgtacgcatagccagcagcagtagcgggagaggaagatgatgatgactcaagtggccaatcacagcaagaggaaccacaccgacagctacttcagcgggaagcagcagcagcaggccgtcgccaccaccgccaccagcagcggctcggaggagttcgcgggcatggggtccaagaagccgaggaacgccagccccaggggcggcggccccatttctcccagggagaagaaagacaaggtcggcgagagagtggcggcgctgcagcagctcgtgtcgccatttgggaagacggacacagcttctgttcttcaggaggcctcgggctacatcaagttcttgcaccagcagctcgaggttcttagctccccgtacatgcgccctcctccgtcgcccggcgccgagcctgaggatcccgaccactacagcctgcggaaccgcggcctgtgcctggtgccggtggagcagacgctgcagctgacccagagcaacggggccgacctctgggcgccggcgaacaccaccaggcgctgctgaagcgaagcccgaggctggcctcgacggcggcgatggccgcactgcgtggcaggggtagaattccggtacaagcgcgcgcatggctgacccaattcggtcaatctctaacacaatcgtttcgtttcgtttggtttcgtttctgtgaacatcctcagcagaccctgtgctggcgccggtagtatgtaatgtgtaatcgtcgtgtatagcgagacgacgcaccgccgaccgatcggtcgatcggtccccgtggtcgttgcgtgggtgactgtggttaacatggtagcgtcctgttgctgtcaaaaaaaaaaaaaaaa

SEQ ID NO: 434 - DNA, 1157 bp, Zea mays
  misc_feature (1)..(1157): Ceres CLONE ID no. 282892
  misc_feature: Encodes the peptide sequence at SEQ ID No. 166
cttcaattcttccccaacgcaggctcttcccccgcacagcagcatctttcttctcctcttcgcggcgcgtcctccgggttaaggaaaaaaaagcggggaaaagggagaagaatcgcacgtcccgccgccgcccgctctgctagtgctagctgctgctggtttggtcgtttcccggccgccgcgccggtgacgcagatcgacagctcctgcccatctcagagtccatcgccgctgatcctgcctgtgcctgcgaaacacgcgcggggcaaggacggagctggtaagccgatcgagccggcgagggtggacaagatgatgatggccgaggtggccgccaaccacagcaaaaggagccacaacgacggctacttcagtgccaaagccgccgccgccgccgccgcgagcccagaggagttgggaagcatgtccatgtcctcgaagamgccgaggaatagcaacagcccgagaaccgcgcccgtatcgcccaaggagaagaaggacaggatcggcgagagagtcgcggcgctccagcagctagtgtcgccgttcgggaagacagacacggcttccgttctccaggaggcgtcggggtacatcaggttcctgcaccagcagctccaggtcctcagctccccttacatgmgtgctcctycggctgccggcgccgcgcctgaggataccgagcactacagccctccggagccgcgggctgtgcctggtgccggtggaccagacactgcagctgacccagagcaacggggccgacctgtgggcgccggcgaacacgaccaggcgcaggtgaggaggagcctgctgccggcctgtgcctggtggtggtctgcccggaggaaaccgcgcaagtactactgctgtgtctgcatggtgcgcgtgtagtacagtttccaagcgcctgacccaattcgatctcctaacaagaagctaagcattaagcaagcgtgtccgtatcagccgccttgtattataccagtgacctgtcggcgccgtatatgtgtgatctgcbtgctagctgatccacacagatggaagcggccctgaactgcgtctccatgtggtactagtactatgtaactatgtgtttactgacttgtgaactagcagtctgtggcctgtcagcaagtaaatgggggcagtttaat

SEQ ID NO: 435 - DNA, 1256 bp, Zea mays
  misc_feature (1)..(1256): Ceres CLONE ID no. 284046
  misc_feature: Encodes the peptide sequence at SEQ ID No. 167
gatcccaaatgtgcccggcccggtccctctgcactgcgctgcgcccatccatccttaaaccctcctgcgcgcgtaggcctcgtctcgtgcttccccagcacaacctttcctcctccttcgccaggtgcctcttcgttctcctctccgtttccctgcgtggcgcgcgcggcgctccgggctatcaggacgaaataactggccgcgctgcacaccggccgccgcgagaagaagcgctcgccccgcgcgctctgccgctggttcggccgtgccatccccggccggtgcttcttccccccctgtgcccgcttgatctccttccgcgcgcacgcacacgcagtggtccgtcgcccgccgctgattgatcctgcaggaaaaacagggcaaggagctactttgagcccgagactagactgaagaagatgatgatggccgaggtggccaaccacagcaagaggaaccacacggacagctacttcagtggcaaggccgtcgccgccaccagttcggaggagttcggcagcatgtcgtcgaagaagccgaggaatgccagcccgagactcgcgcccgtatcaccaaaggagaagaaggacaagatcggcgagagggtcgcagcgctccagcagctcgtgtcaccgttcgggaagaccgacacggcttctgtcctgcaggaggcgtcggggtacatcaagttcctgcaccagcagctggaggtcctgagctccccttacatgcgcgctcctccggccgctggcgctgcgcctgaggacccccagcgctacagcctccggagccgcgggctgtgcctggtgccggtggacctgacgctgcagctgacccagagcaacggggccgacctgtgggcgccggcgcacacggccaggcgaaggtgaggactgaggaggagccggtctgtctgtccggagggaaccgcgcaagtgctgccgcgtctgcgtgcgcgccgtggagttgagtttccaggcgcctgactgacccgattcgacctcctagcaagaaactaaagcaagcgtgcgtgtccgtatcagccgccttgtattatactcctagtagtactctagtgacctgcctggtctggtgtggtctggtctctccttgttgtccgccgtatatgtgttgagtggcatgtggattagaagcctgtgtggctggctgtcagcaagcagagcggcagtttgatgcctgttccttgagatggatagtgttatcgagttcagaagaataccatgcgcgtgtgcctg

SEQ ID NO: 436 - DNA, 622 bp, Zea mays
  misc_feature (1)..(622): Ceres CLONE ID no. 1388825
  misc_feature: Encodes the peptide sequence at SEQ ID No. 168
tgcggtctgcctctgcccttaccgctacgctttcctcccggattccagcagcgaaacacgcgcggggcaaggacggagctggtaagccgatcgagccggcgagggtggacaagatgatgatggccgaggtggccgccaaccacagcaaaaggagccacaacgacggctacttcagtgccaaagccgccgccgccgccgccgcgagcccagaggagttgggaagcatgtccatgtcctcgaagaagccgaggaatagcaacagcccgagaaccgcgcccgtatcgcccaaggagaagaaggacaggatcggcgagagagtcgcggcgctccagcagctagtgtcgccgttcgggaagacagacacggcttccgttctgcaggaggcgtcggggtacatcaggttcctgcaccagcagctccaggtcctcagctccccttacatgcgtgctcctccggctgccggcgccgcgcctgaggataccgagcactacagcctccggagccgcgggctgtgcctggtgccggtggaccagacactgcagctgacccagagcaacggggccgacctgtgggcgccggcgacacgaccaggcgcaggtgaggaggagcctgctgccggctg

SEQ ID NO: 437 - DNA, 1002 bp, Glycine max
  misc_feature (1)..(1002): Ceres CLONE ID no. 611156
  misc_feature: Encodes the peptide sequence at SEQ ID No. 172
attatccagcaaacactatctcaatagtgaagctctaaaccactgccaagtatggtagtttcttcgtgctctttgagctggatttcaccttgcttatcccataagctaaacttgccacatacaaattgtttgcctcgcaacattgcaacttcatcttccaacactgtcttttgtgaattggacacaacccccagcggagaaagtcattgccggagaagaccgctactgttaggcattggagcattaactgcaaatttacaaccaacaaatttggtctttgctcaagaaaaaccagacagataccgagcttttgtggactatgaagatgggtattcttacgtatatcccattgattggaaggaatttgacttcagggctcatgattctgcattcaaagacagatatctacagttacagaatgtacgggtgagatttataccaaccgagaagaaagacatccgagatttgggtcctatggaagaggttatatacgatttggtgaaacatagatacgcagcaccaaaccaaagaccaacaataaatgacatgcaggagaaaaccatagatggaaaacattactatacctttgaatatatacttacatcaccaaattattctagtgcctcctttgcaacaattgctataggaaatggaaggtactacacgttaattgttggagccaatgaaaggcgatggaaaagatttcgagatcagcttaaagtggtagcagactcctttaggcttcttgacatctgaaatgtcacgggacaatgcaaaacatgttttaatttgcctacagatcaagtttgaaatattcgtatatcagagcaaaataagtttttacaagtgaatgatatcttctactataccaatagaactctcttttgtacatcgcatgcaaagtgactttgtctgtcatttgtggtgcaaactcaattcgttgttcctcgtctactcttacattgttccactgctactcctttatggagtatttcggttggg

SEQ ID NO: 438 - DNA, 720 bp, Arabidopsis thaliana
  misc_feature (1)..(720): Ceres CLONE ID no. 1346445
  misc_feature: Encodes the peptide sequence at SEQ ID No. 194
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (629)..(629): n is a, c, t, g, unknown, or other
aacttcttcttctcttccgtttcaccaccctttcttctcctaaattcgaagaaccaaaaccaaaaaccaaaaacgtgaattcggagagtcttcaattggaatttggatcgtgggattttggaaatggcatcgaaacggattttgaaggaattgaaggatctgcagaaggatcctcctacttcatgtagcgcaggacccgttgcggaagacatgtttcattggcaggccactataatgggtccatcggatagcccttattctggaggagtttttcttgtaaccatccatttccctccagattacccatttaagcctcctaaggtggcttttaggacgaaggtgttccatccaaacattaacagcaatggaagcatctgcctcgacatcttgaaggagcagtggagtcctgctctcacaatttccaaggtgctgctatcgatctgttctttgttaacggatccaaacccagatgatcctttggtccctgagatagctcacatgtacaagacagacaagaacaagtacgagtccactgctcggacctggacccaaaagtatgccatgggctgacannnntactgtccttaaaggagagccctaataattaaactcttcttatttctatggantgatcttttatagacttgtctgtcttataaaattgtgaagacaggatcagtaagaaatatttgatctccattctatggaactgtaaaacgt

SEQ ID NO: 439 - DNA, 759 bp, Triticum aestivum
  misc_feature (1)..(759): Ceres CLONE ID no. 617835
  misc_feature: Encodes the peptide sequence at SEQ ID No. 207
agttccgtcccattattggttcttgcgaggaggggggcggagaaacggaagcaggaggcagagaggagatcgagccagagggcggcgagcaagggcgcgatggcgtccaagaggatacagaaggagcttaaggatctgcagaaggacccccctacctcatgcagcgcaggtcctgtgggtgaagatatgttccattggcaggcaacaataatgggcccatctgacagcccatattctggtggagttttcctagttactatccacttccctcctgattatcctttcaaaccaccaaaggtggcattccgcaccaaggtgttccatccaaacatcaacagcaacgggagcatttgtctggacatcctcaaggaccaatggagccccgctctgaccatttccaaggtgctgctgtccatctgctccctgctgtatgacccgaaccctgatgaccctctggtccctgagatcgcccacatgtacaagacggaccggcacaagtacgagagcaccgccaggacctggacgcaaaggtatgccatgtaatgcaagacggcggatgggtcgccggagtcagtcttgtttgtaacattctcgatcagttcgtgtgtgcccgcccagtgtgtcacctgtctgtcaaactggcactcgttgctcaactgtgtcacctggcgcagtgacttggaacatggaaccggtgttgcatattttggattcagataaatgtagccacctgcctgccacttaaaaaaaaaaaaaaaa

SEQ ID NO: 440 - DNA, 771 bp, Arabidopsis thaliana
  misc_feature (1)..(771): Ceres CLONE ID no. 39130
  misc_feature: Encodes the peptide sequence at SEQ ID No. 215
gtattcttcgtctttcgtccaccaccatctctattttcttcctttcccctaagtcttggttcttcttctctctaatacgagaagaaaaaggcgaaaacctcgccaatccgattacgcgaaaaatcaaaggtttttggatatggcgtcgaagcggatcttgaaggaattgaaggatctccagaaggatccacctacatcatgtagcgcaggtcctgttgctgaagacatgtttcactggcaggcaacgataatgggtccttcagagagtccttatgctggaggtgttttccttgtaaccatccatttccctccggattacccattcaagcctcctaaggtggcctttaggaccaaggtgttccatcccaacattaacagcaacggtagcatttgcctcgacatcttgaaggagcagtggagtcctgcgctcaccatttccaaggtgctgctatcgatctgttctttgttaaccgatccaaacccggatgatcctttggtgcccgagatagctcacatgtacaagactgacaagaacaagtacgagtccactgcacgaagctggactcagaagtatgccatgggctaaatggaaaatcccacctactaaattatctctttatgaagaaaaaaatctgccttaatttctatgtatgattcgatagacatctctttgtgtccttttaactttctgaagacaggaccaaatgaagtgggtcttgttttaaacgaaacaaaaaaaaacatcatctttgtgaaaactagaatctgatc

SEQ ID NO: 441 - DNA, 747 bp, Arabidopsis thaliana
  misc_feature (1)..(747): Ceres CLONE ID no. 16865
  misc_feature: Encodes the peptide sequence at SEQ ID No. 216
attcgcttccgtttcttaaagcataaaaaccaaaactttctctttcgttttgctttcttccaagcatctgcaggagtgaatcgcaaaaccaaatttggaggattctttctgaggggtttctcagtgagaaaatggcttcgaaacggatcttgaaggagctgaaggatctccagaaagaccctccaacctcctgcagtgcaggtccagttgctgaagacatgtttcattggcaagctacaattatgggtcctgcagagagtccgtattcaggcggtgtgtttctcgttaccattcacttccctccggactatcctttcaagccaccaaaggttgcatttaggacgaaggtgtttcaccctaatatcaacagcaacggaagcatttgccttgacattttgaaagaacaatggagccctgccctcaccatttcgaaggtgttgctttcgatatgttcgctgttaacggatccaaatccagatgacccgttagtgccagagattgcacacatgtacaaaaccgacagagccaagtacaaggctactgctagaaactggactcagaagtatgccatgggctaaacaaagattcgtatgcttcagcacctgtttatgctcttatatctgtttatttctttttcttgttttaactctaataaaaatgtctaaaaatatcaacttttttcgtctgtactatatgtttatggttttattatcatcatctttatctgaaatttgaagatggaattcc

SEQ ID NO: 442 - DNA, 709 bp, Glycine max
  misc_feature (1)..(709): Ceres CLONE ID no. 575067
  misc_feature: Encodes the peptide sequence at SEQ ID No. 217
aggaattggaattagaattgtaaaaaggaaaggggaaggaagcaaggcaaggaaggagagtggatcgattcctcagcagcaccagacatttataaaagctctttcccttccctcaaatcgctcatactcttccaatctttttttttttttttttttacctttctccctcgctcaataatacaaaacaaaaaagaagaagaagaaggttttcgcgatggcatcgaaacggatcttgaaggaactcaaggatctccagaaggatcctcctacctcttgcagcgccggtcctgttgctgaagacatgtttcactggcaagcaacaattatgggtcctccagacagtccttatgctggaggtgttttcctagtcactattcatttccctccagattatcccttcaagccacccaaggttgcattcagaacaaaggtatttcacccaaatataaatagcaatggaagcatttgccttgacatattgaaggagcagtggagccctgcgctaactatttcaaaggtgttgctctcgatttgttccctgttgacggaccctaatcctgatgatcctttggtccccgaaatagcccacatgtacaagacagacagaaacaagtacgagtcaactgccagaagctggacccagaaatatgccatgggttaartkacmybtgkggtwtgtgtragraarascctttytactcccagtgtt

SEQ ID NO: 443 - DNA, 743 bp, Arabidopsis thaliana
  misc_feature (1)..(743): Ceres CLONE ID no. 25162
  misc_feature: Encodes the peptide sequence at SEQ ID No. 220
ctttcccctaagtcttggttcttcttctctctaatacgagaagaaaaaggcgaaaacctcgccaatccgattacgcgaaaaatcaaaggtttttggatatggcgtcgaagcggatcttgaaggaattgaaggatctccagaaggatccacctacatcatgtagcgcaggtcctgttgctgaagacatgtttcactggcaggcaacgataatgggtccttcagagagtccttatgctggaggtgttttccttgtaaccatccatttccctccggattacccattcaagcctcctaaggtggcctttaggaccaaggtgttccatcccaacattaacagcaacggtagcatttgcctcgacatcttgaaggagcagtggagtcctgcgctcaccatttccaaggtgctgctatcgatctgttctttgttaaccgatccaaacccggatgatcctttggtgcccgagatagctcacatgtacaagactgacaagaacaagtacgagtccactgcacgaagctggactcaggagtatgccatgggctaaatggaaaatcccacctactaaattatctctttatgaagaaaaaaatctgccttaatttctatgtatgattcgatagacatctctttgtgtccttttaactttctgaagacaggaccaaatgaagtgggtcttgttttaaacgaaacaaaaaaaaacatcatctttgtgaaaactagaatctgatcatcttctgttgcc

SEQ ID NO: 444 - DNA, 803 bp, Zea mays
  misc_feature (1)..(803): Ceres CLONE ID no. 1405728
  misc_feature: Encodes the peptide sequence at SEQ ID No. 223
cttcgttcttcttcacctaaaactgcgagaaggaaaaaaggcgaaaagctcgccgatcgggagtccgcgaaaccaaagagatcgtaggttttggatatggcgtcgaagcggatcttgaaggagctgaaggatctgcagaaggatccacccacctcatgtagcgcaggacctgttgctgaagacatgtttcattggcaggcaacgataatgggtcctaccgacagtccttatgctggaggtgttttccttgttaccattcacttccctccagattaccctttcaagcctcctaaggttgcctttaggacgaaggtgttccatcccaacattaacagcaacggaagcatttgcctcgacatcttgaaggagcaatggagtcctgcactcaccatttccaaggtgctgttatcgatatgttctttgttaaccgatccaaacccagatgatcctttggtgcctgagatagctcatatgtacaagactgacaagaacaagtatgagtccactgcacggagctggactcagaagtatgccatgggctgaaaggaaggatcctaaactatctctttttatggaaaaaatctgccgtaatttctatgtatgattcagtagacatctgtttctgtcgtccttttaaaatttctgaagacaggaccaaatgaagtgggtcttgtttgtttgaaacaaaaaaaaaaacaaaacatctttgtgaaactagaaactggaaatctttctggttttgtttggtcttgtcttgcaattatgatttggtgttttactgtgtgataaaaaaaaaaaaaaaa

SEQ ID NO: 445 - DNA, 831 bp, Triticum aestivum
  misc_feature (1)..(831): Ceres CLONE ID no. 1031152
  misc_feature: Encodes the peptide sequence at SEQ ID No. 232
aaatcctccgactccttctcgccccctcttgccccgtggtccccaaccgccgtccgccgccgcagaggggagaggcggccgccgcccaccgccgcagcaccgccggccccgtcgcccccgccggtcgggtttgatcccatggcgtccaagaggatcctcaaggagctcaaggacctgcagaaggaccctcccacctcatgcagcgcaggtcctgtaggtgaggacatgttccactggcaggccactatcatgggaccctcggacagcccgttcaccggtggcctatttttggtgaacattcatttcccaccggattaccccttcaagcccccgaaggtctctttccgcaccaaggtgttccacccaaacatcaacagcaacggcagcatttgccttgacattctcaaggaacagtggagcccggctttgaccatatcaaaggtcctgctgtcaatctgttcgttgctgacggacccgaaccccgatgatcctctggtgcccgagatcgctcacatgtacaagactgatagggccaagtatgagtccacggcgcgctcctggacacagaagtacgccatgggctagagcttgacggccagctggtgaccatggatgcgccgagccagaaccgttatcacctaaataaccagccaaaagtatcaccccaccccgtgacgaagtgaatggacttttgaggccgtcgtgcccctgttgaactcgtatgaatgtactcttgccatgtcaagtccgttgggtctgggtagtctgttctacctgacgtttcgttatccgttaagttaaatctctgtcgtatcaaaaaaaaaaaaaaaa

SEQ ID NO: 446 - DNA, 874 bp, Triticum aestivum
  misc_feature (1)..(874): Ceres CLONE ID no. 878043
  misc_feature: Encodes the peptide sequence at SEQ ID No. 235
aaaccaaacccgtcgcgcacgacaccacaccacaaagcgaggggcggacccggagcaaaaaagaccaccaaaggcaggcgtcctccgtccctctgtcctcgccgtccccaacctctcgctgcaaaaaggttgcttgtcatggcatcaaagcgcatcctcaaggaactgaaggacctgcagaaggacccgcccacatcatgcagcgcaggtcctgctggtgaggacatgtttcattggcaagcaacaattatgggaccccctgacagtccctatgccggtggtgttttcttagtgaacattcatttccctccggattaccccttcaagccaccaaaggtatcttttaagacaaaggtcttccatcctaatatcaacagcaatggaagcatatgccttgatattcttaaggagcagtggagccctgctttgacgatctctaaggtcttgctctctatctgttccctgctgaccgatcccaacccggatgatccccttgttcccgagattgcccacatgtacaagacggaccggtcaaagtatgagacgacagcccgcagctggacgcagaagtacgccatgggttgaagacctgcatcgtggacaactgaaatgtcgcttcaagaaaaatatttatgggccattgtttcttcgatttgttgctggttgtgtgtaatccaatcctcaaggattgtaaattgcattcggcgtcggtcctatcatcaattgccactagtatcggcagacatgcatgcctatcagcctattcacctatgcttgttgggttaaccttcatcagtgttggtgttatttggtaaatgttcattaaaacatgtttgcttaatgaccttgtccagattcaaaaaaaaaaaaaaaa

SEQ ID NO: 447 - DNA, 689 bp, Glycine max
  misc_feature (1)..(689): Ceres CLONE ID no. 511132
  misc_feature: Encodes the peptide sequence at SEQ ID No. 238
ttcttgcttctccatcgagttggattgggttcaaagttgggcttttggacagctgtggtgtgcacggcagctctgtgacttgtgaggaggaagggaggaagaaagcggatccatggcgtcgaagcggatcctcaaggagctcaaggacctgcagaaggatcctcccacctcttgcagcgcaggccctgattgccgaagatatgttctactggcaggcgacgattatggggccatcagatagcccatacgctggtggcgdtatttttggtcactattcactttccaccggactacccattcaaaccaccgaaggttgcattcaagackaaggtttaccatccgaatatcaacagcaacgggagcatctgtcttgatatcttgaaggagcaatggagccctgcactgacagtttctaaggtcctcctctcaatttgttcccttctgacggacccaaaccctgacgatccgttggtcccagagattgctcacttgtacaagactgatcgcgtgaagtacgaatcgactgctaggagctggactcagaaatatgcaatgggctgacaagctattggtctctcgtagacctaaagcacgtactgccttctgtaactgaaaccagatgtctaaattaatttgtccattcgtgcatcgaacttttgatatataatggaaggagaaacattgatagc

SEQ ID NO: 448 - DNA, 750 bp, Arabidopsis thaliana
  misc_feature (1)..(750): Ceres CLONE ID no. 10022
  misc_feature: Encodes the peptide sequence at SEQ ID No. 244
aaaacaaccccttgagatttccgaagatcatcaaatccaaaaccctagaaaccgaacaaaagctagcagaagctaggactattcaatggcgtcgaaaagaattaacaaagagcttagggacttgcaaagagatcctcctgtgtcctgcagtgcaggtcctacgggagatgatatgttccaatggcaagcaactatcatgggtccagcagatagcccgtttgccggaggtgtgtttcttgttaccattcacttcccaccagattaccctttcaagccaccaaaggttgccttccggaccaaggtttatcacccaaacatcaacagtaatggaagtatctgtcttgacattctgaaagagcagtggagccctgcacttaccgtatccaaggttcttctgtcgatatgctcattgctgacggatccaaaccctgacgatcctttggttcctgaaatagcgcacatctacaagacagaccgagtcaagtacgagtccacagctcaatcctggactcagaagtatgcaatgggatgataacaagcaataatacccaccaccagtacattgcgtattaaacaggagaaataagaaagaaagaaaaaaactcagtttggcttttactttggctacttttgcttattagtttttttttttaattatatcttgaagctgtgtgttgggtgtgtacatgagctttatgccttatttgaaacattgagatcttgcaaatgcttttaagccaataatccgct

SEQ ID NO: 449 - DNA, 747 bp, Arabidopsis thaliana
  misc_feature (1)..(747): Ceres CLONE ID no. 12547
  misc_feature: Encodes the peptide sequence at SEQ ID No. 245
aaaacaaccccttgagatttccgaagatcatcaaatccaaaaccctagaaaccgaacaaaagaagctaggactattcaatggcgtcgaaaagaattaacaaagagcttagggacttgcaaagagatcctcctgtgtcctgcagtgcaggtcctacgggagatgatatgttccaatggcaagcaactatcatgggtccagcagatagcccgtttgccggaggtgtgtttcttgttaccattcacttcccaccagattaccctttcaagccaccaaaggttgccttccggaccaaggtttatcacccaaacatcaacagtaatggaagtatctgtcttgacattctgaaagagcagtggagccctgcacttaccgtatccaaggttcttctgtcgatatgctcattgctgacggatccaaaccctgacgatcctttggttcctgaaatagcgcacatctacaagacagaccgagtcaagtacgagtccacagctcaatcctggactcagaagtatgcaatgggatgataacaagcaataatacccaccaccagtacattgcgtattaaacaggagaaataagaaagaaagaaaaaaactcagtttggcttttactttggctacttttgcttattagttttttttttttaattatatcttgaaactgtgtgttgggtgtgtacatgagctttatgccttatttgaaacattgagatcttgcaaatgcttttaagccaataatccgctacc

SEQ ID NO: 450 - DNA, 646 bp, Arabidopsis thaliana
  misc_feature (1)..(646): Ceres CLONE ID no. 27679
  misc_feature: Encodes the peptide sequence at SEQ ID No. 246
aacaaaccactcatattttttttcacatacttctttgtagtgctactttccattatatcaaacactcagcaacctgatggcaacgagacggatattgaaagaattgaaggagttgcaaagagaccctcctgtatcatgcagtgcaggtccaacaggagaagatatgttccactggcaagctactataatgggtccgaatgaaagtccttactccggaggtgttttccttgtcaatatccatttccctcctgattatccttttaaacctcccaaggttgtattcagaaccaaagtgtttcacccaaacatcaacagtaatggaaacatatgtttggacattctcaaagaccaatggagccctgcccttaccatttctaaggtgcttctctctatatgctctcttctaacagatccaaaccctgacgaccctctggtgccagagatagctcacatatacaaaactgacaagaccaaatatgaagccatggctcgaagctggacccagaagtatgccttgttttaaagctcacaattcctctttttttcctttttattttggtttggtcttatttgtaataaaaaaagaagaagaagaaattgttataattttaatacaaacatatataatatataaagtagagttttc

SEQ ID NO: 451 - DNA, 752 bp, Zea mays
  misc_feature (1)..(752): Ceres CLONE ID no. 1063753
  misc_feature: Encodes the peptide sequence at SEQ ID No. 250
aacctcttgagatttcccgaagatcaaatcaaaaccctacgaaaggttagctagaagcagcgagtacagttcaagatggcttcgaaaagaatcaacaaagagcttagggacctccaaagggatcctcctgtctcatgcagtgccggtcctgtgggtgatgatatgttccactggcaagcgactatcatgggtccaactgatagcccattctccggtggtgtgtttcttgtttccattcacttcccaccagattaccccttcaagccaccaaaggtttctttccgcaccaaggtttaccacccgaatgtcaacagtaacggcagtatctgtcttgacattctgaaagagcagtggagccctgcacttaccatatccaaggttcttctgtcgatatgttcattgctgacagatccaaaccctgatgaccctctggttccagaaatagctcacacctacaagacagaccgagtcaagtacgagagcaccgcccgatcctggacccagaagtatgcaatgggatgatgatgattggcaataataatccgcaccaatactttgcgcattgtctaagaatatgagaaataagattgaaaaaaaaacagtgtgtggcgttttgcttggttgctttattagttttatcatcatcttaagccgtgtgttggtttgtgtacatgagctttatattgagacattttgagagcttgcaatgctataaagccaataactggttatctataaaaaaaaaaaaaaaa

SEQ ID NO: 452 - DNA, 738 bp, Zea mays
  misc_feature (1)..(738): Ceres CLONE ID no. 1357060
  misc_feature: Encodes the peptide sequence at SEQ ID No. 254
aacctcttgagatttcccaagatcaaatcaaaaccctacgaaaggttagctggaagcagcgagtacagttcaagatggcttcaaaaagaatcaacaaggagcttagggacctccaaagggatcctccagtctcatgcagtgccggtcctgtgggtgatgatatgttccactggcaagcgactatcatgggtccaactgatagcccattctccggaggtgtgtttcttgtttccattcacttcccaccagattaccccttcaagccaccaaaggtttctttccgcaccaaggtttaccacccgaatatcaacagcaatggcagcatctgtcttgacattctgaaagagcagtggagccctgcgcttaccatatccaaggtccttctttcgatatgctcactgctgacagatccaaaccctgatgatcctctggttccagaaatagctcacacctacaagacagaccgagtcaagtacgagagcactgcccgatcctggacccagaagtatgcaatgggatgatgatgattggcaataataatccgcaccaatacattgcgcattgtctaagaatatgagaaataagattgaaaaaaaaacagagtgtggcgtttacttggttgctttattagttttatcatcatcttaagacgtgtgttggtttgtgtacatgagcttttatattgagacattttgagagcttgcactgctttaaagccaataaagggctgttatgatt

SEQ ID NO: 453 - DNA, 938 bp, Zea mays
  misc_feature (1)..(938): Ceres CLONE ID no. 376667
  misc_feature: Encodes the peptide sequence at SEQ ID No. 257
aatatcaatagaagtgacaactccatctctggtctcccagactcccacgcctataatctcattcccctccttcaaagccctctggcgatcgagattcttccccctccgtctccagatatggcaaacaaaaggattcagaaggaactcatggatctgcaaaaggacccaccgacatcatgcagtgcagggccagctggagaggatctattccactggcaggccacaatcatgggtcctagcgacagcccctatgcaggaggggttttctttgttaatatccattttcctcctgactacccgtttaagcctccaaaagtgaacttccaaacaaaagtttatcacccgaacatcaactctaacgggagcatctgccttgatatcctcaaggagcagtggagccctgcactgaccatatcaaaggtcctcctctccatcagctcgcttctgactgaccccaacccagacgaccccctcgtccccgagatcgcccacatgtacaagaaccagaggccgcgctacgaggaaaccgcacgggcctggacccagaagtacgcgatgggctagctgattctgtgttgccgaacaatactgtcactgccaagaagatcatcatcacgacgttgtaagaaattaagttgaaccggtttccccgtcgtgtgatggtattaagagcccagatggctgctgcgtcagttatactagcttcgcagaccaaagttcttctgtgtgtacagtacttttgaagctggatagtctgaatcctgtgccagaacctaaggtcttcgctttgttccctgaagagcgtttgtgaccatagaatctgcatctgtaaccttgccagctaagaaaacagacagtagctgcttgtatgatgtcgagatgctatagttccgatgggtggaaccgtgcagatgaaacagtccagtggtcttgcgttc

SEQ ID NO: 454 - DNA, 915 bp, Zea mays
  misc_feature (1)..(915): Ceres CLONE ID no. 256705
  misc_feature: Encodes the peptide sequence at SEQ ID No. 258
agatccgtgttccgtgtccgcgtccagtgtgtccgctactccgctccccctcagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaacatcatgcagtgcaggtcctgctggtgaggatatgttccactggcaggcaaccatcatgggtcctcctgatagtccatatgctggaggtgttttcttggtgaacattcatttcccgccagactaccccttcaagcctccaaaggtatcttttaagacgaaggtcttccatccaaacatcaatagtaatggaagcatatgtcttgacattcttaaggagcagtggagccctgctttgacaatctctaaggttttgctttctatctgctccctgcttactgatcccaacccagacgaccctcttgtccctgagattgctcacatgtacaagacggatcggcctaagtacgaggcgacagcccgcagctggacccagaagtacgccatgggatgaaatgttcggcgttactggctaaatgcagacgattgtggtgttgcccatgaaactgttatcggggacgtatgttcttctgttccttgtgcattctccgatccatctctaggatccgagttctagtccaacattaacctaccattgccttgggtaatgagatgacttgtgcttgctgtggtaactatgctagtgttgatgttaatgattctc

SEQ ID NO: 455 - DNA, 773 bp, Zea mays
  misc_feature (1)..(773): Ceres CLONE ID no. 1061097
  misc_feature: Encodes the peptide sequence at SEQ ID No. 261
atctacgaaccaaccaaccaacgaagaagcctcttgagatttcccaagatcaaatctaaaaacccttagtagctgactattcaagcttatggcttcgagaagaattaacagcgagcttagggacctgcaaaaggaccctcctctgtcttgcagtgccggtcctgtgggtgatgatatgtaccactggcaagcaactatcatgggtccaactgatagcccattcaccggtggtgtatttcttgtttccattcacttccctccagattaccccttcaagccaccaaaggtttctttccgcaccaaggtctatcacccgaatgtcaacagtaatggcagcatctgtcttgacattctgaaagagcagtggagccctgctcttaccatatccaaggttcttctgtcgatatcctcattgctgacagatccaaaccctgatgatcctctggttccagagatagctaacatctacaagtcagaccgtaccaagtacgagaacactgcccgatcctggacccagaagtatgcaatgggatgatatgatgatggttggcaataatgatccgcaccagtaaattgcgcatttgtctaagaattggggaaataagaagaaaaaaacatggatttggcttttgcttgcctgcttgatttaattagttttattatcttcttatgtgttgggtgtgtacatgagcgctatttaagccttattgaaacatttgatatctttcttttaatccagtaattggctattataacgaaaaaaaaaaaaaaaa

SEQ ID NO: 456 - DNA, 509 bp, Zea mays
  misc_feature (1)..(509): Ceres CLONE ID no. 1380019
  misc_feature: Encodes the peptide sequence at SEQ ID No. 265
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
agtgaaccgagtttggaggatctgtgaagaaaagcaagaaatggcttcgaagcggatcttgaaagagctcaaggatctccacaaggatcctccttcctcctgcagtgctggcccagttgcggaagacatgtttcattggcaagctacaataatgggtccatccgatagtccttactctggcggagtctttctcgtaaccattcacttccctcccgattatcctttcaaaccaccaaaggttgcatttaggacaaaggtgtttcaccctaatgtcaacagcaatggaagcatttgcctcgacattttgaaagaacaatggagtcctgcactcaccatatccaaggttttgctttcgatatgttcattgttaacggatccaaacccagatgatcctttggttccagagattgctcacatgtatannncggacagagccaagtatgagtctactgctaggagctggactcagaaatatgctatggggtaaagtttctgcttttgaccatcaa

SEQ ID NO: 457 - DNA, 1306 bp, Glycine max
  misc_feature (1)..(1306): Ceres CLONE ID no. 1641329
  misc_feature: Encodes the peptide sequence at SEQ ID No. 338
aactcattccttttaagcacaatagaagaagaagaacaacaacaacaacagcagcatatctcagatatcatcatggccgttgaagcgcgccatctcaatctcttcccttctcaactcatcaccaaccggtatatatatcactaccccttcctcttctaatctttcttaaaaattcttgtttttgtttattatttactattattctcacttttgtgaaatttcttaaatgattattcaggcaagtgatggattctggtgaggcgaatatgatgaacatgtacaacaacagcactccgattggtggttactcttcgtttctgccgttatccggcgccgtcacggagacggcgcttccgtcctcggttttcaaccattctctcgccaacgccgtcaaatccgaaagcggcgttacctacaacaacaacaacaacaacaacaacgtttctgtttctcccatgtcgagaaagcgttcccgagataataacaacaattacggttacaacaacaacaacaacgattcattttcgtttctcggccaagacgtttctctccagatccagcagcagcaactcgacatcgagcatttaatcatgcaacgcatggagaaggtgagaatggagattgatgagaagaggaagaggcaagcgaggaggatcattgaagcgattgaggttggagtgatgaagaagctgaagacgaaggaagaggagatagagaaaatcggaaaactgaattgggcgttggaagagaaagtgaagcatctctgcatggagaatcaggtgtggcgtaacatagcggaaaccaacgaagccacagcgaatgctctgcggtgtaatttagagcaggttctcgcgcagcgcggcggaatggcggcggaggaagacgtcggcggaggcgccaccgtgtgcggcggcgcggagatggacgacgccgagtcctgctgcgggagcaccgaggaggacggtttagaaaaggaaacggggggttggcgcacgttagcggggtgcgcaggggtgaaggataaggagggtggtggtaatgggaggttgtgcaggaactgtaggaaggaagagtcttgtgtgctgattttgccgtgccgtcatttgtgcttgtgtactgtgtgtgggtcttcactccacatttgtcccatttgtaaatcctataagactgctagtgtgcatgttaacatgtcctaatttttggataagataggactctaggaccttaatgagaatcatctctttgtctcaactcaatctcataaaaggaaaaaatatatcaaatttcaaaaaaaaaaaaaaaaaaa

SEQ ID NO: 458 - DNA, 1280 bp, Glycine max
  misc_feature (1)..(1280): Ceres CLONE ID no. 1650419
  misc_feature: Encodes the peptide sequence at SEQ ID No. 339
actctttgtatatttttctttctcccttcttccttcacatccattgctctctcttctctcacccaacaaaaactcattccttttaagcacaatagaagaagaagaacaacaacaacaacagcagcatatctcagatatcatcatggccgttgaagcgcgccatctcaatctcttcccttctcaactcatcaccaaccggcaagtgatggattctggtgaggcgaatatgatgaacatgtacaacaacagcactccgattggtggttactcttcgtttctgccgttatccggcgccgtcacggagacggcgcttccgtcctcggttttcaaccattctctcgccaacgccgtcaaatccgaaagcggcgttacctacaacaacaacaacaacaacaacaacgtttctgtttctcccatgtcgagaaagcgttcccgagataataacaacaattacggttacaacaacaacaacaacgattcattttcgtttctcggccaagacgtttctctccagatccagcagcagcaactcgacatcgagcatttaatcatgcaacgcatggagaaggtgagaatggagattgatgagaagaggaagaggcaagcgaggaggatcattgaagcgattgaggttggagtgatgaagaagctgaagacgaaggaagaggagatagagaaaatcggaaaactgaattgggcgttggaagagaaagtgaagcatctctgcatggagaatcaggtgtggcgtaacatagcggaaaccaacgaagccacagcgaatgctctgcggtgtaatttagagcaggttctcgcgcagcgcggcggaatggcggcggaggaagacgtcggcggaggcgccaccgtgtgcggcggcgcggagatggacgacgccgagtcctgctgcgggagcaccgaggaggacggtttagaaaaggaaacggggggttggcgcacgttagcggggtgcgcaggggtgaaggataaggagggtggtggtaatgggaggttgtgcaggaactgtaggaaggaagagtcttgtgtgctgattttgccgtgccgtcatttgtgcttgtgtactgtgtgtgggtcttcactccacatttgtcccatttgtaaatcctataagactgctagtgtgcatgttaacatgtcctaatttttggataagataggactctaggaccttaatgagaatcatctctttgtctcaactcaatctcataaaaggaaaaaatatatcaaattttcataaattgacaaattgttgaaaaaaaaaaaaa

SEQ ID NO: 459 - DNA, 1256 bp, Glycine max
  misc_feature (1)..(1256): Ceres CLONE ID no. 597699
  misc_feature: Encodes the peptide sequence at SEQ ID No. 340
ctatttgcatgtcattctctcttcagttttctcccactctttgtatatttttctttctcccttcttccttcacatccattgctctctcttctctcacccaacaaaaactcattccttttaagcacaatagaagaagaagaacaacaacaacaacagcagcatatctcagatatcatcatggccgttgaagcgcgccatctcaatctcttcccttctcaactcatcaccaaccggcaagtgatggattctggtgaggcgaatatgatgaacatgtacaacaacagcactccgattggtggttactcttcgtttctgccgttatccggcgccgtcacggagacggcgcttccgtcctcggttttcaaccattctctcgccaacgccgtcaaatccgaaagcggcgttacctacaacaacaacaacaacaacaacaacgtttctgtcccatgtcgagaaagcgttcccgagataataacaacaattacggttacaacaacaacaacaacgattcattttcgtttctcggccaagacgtttctctccagatccagcagcagcaactcgacatcgagcatttaatcatgcaacgcatggagaaggtgagaatggagattgatgagaagaggaagaggcaagcgaggaggatcattgaagcgattgaggttggagtgatgaagaagctgaagacgaaggaagaggagatagagaaaatcggaaaactgaattgggcgttggaagagaaagtgaagcatctctgcatggagaatcaggtgtggcgtaacatagcggaaaccaacgaagccacagcgaatgctctgcggtgtaatttagagcaggttctcgcgcagcgcggcggaatggcggcggaggaagacgtcggcggaggcgccaccgtgtgcggcggcgcggagatggacgacgccgagtcctgctgcgggagcaccgaggaggacggtttagaaaaggaaacggggggttggcgcacgttagcggggtgcgcaggggtgaaggataaggagggtggtggtaatgggaggttgtgcaggaactgtaggaaggaagagtcttgtgtgctgattttgccgtgccgtcatttgtgcttgtgtactgtgtgtgggtcttcactccacatttgtcccatttgtaaatcctataagactgctagtgtgcatgttaacatgtcctaatttttggataagataggactctaggaccttaatgagaatcatctctttgtctcaaaaaaaaaaaaaaaa

SEQ ID NO: 460 - DNA, 1104 bp, Arabidopsis thaliana
  misc_feature (1)..(1104): Ceres CLONE ID no. 24885
  misc_feature: Encodes the peptide sequence at SEQ ID No. 347
accaccgaaacccactaagaatacagcaaatcgtctcttcgccattaaaacaccttcctttgcaaacaaagcttcaaactttctcttaaaacacccccaaatcagcaaagatagggttaatcgaagaacctcaccgtaagtccactgaggattcaagttcttgctttggtttaaggaagaagaacagcaaaaacctcaaggagaagaagaagtcaaagatgactcagagtcaaaccaacgacggagctggagctggagctgttacgacggtagaatctgttcctcctcagcctcaatctcagcctcagcctcagccgcagcagcagagcaacgagatggttctgcatacgggaagcttgagttttagtagtcatatgtcgagagaagacgaagagatgactcgttctgctctttcggcgtttagagctaaagaagatgagattgagaagaggaggatggaagttcgtgaacggatccaagctcaattgggtcgggtcgaacaagaaaccaaacgtctctctactattcgtgaggagcttgagtctatggcagatcctatgaggaaggaagtttctgtggttcgtaagaagattgatagtgttaacaaagaactcaaacctctaggttccactgttcaaaagaaggaaagggaatacaaagaagcacttgatgayattcaacgagaagaacagggagaaagtacagctgatcacaaaactcatggagatggaacagttggttggagaaagcgagaagttgaggatgattaagctggaggagctgagcaagagcatagaaaccgtgtgaaaaaggttgttcaagaagaactaattgggttcttttgtgtgatgtacctacctagtttaaaattttcatcatgtaagatgtgtgggttgcttttttttttattgbtatagtttttttaaagtctttgggggtttgatttgtaaaatttgkgggttctctcttwtttttgattaaccaaatttagggatatgggaaaatgggagattcttaggatactgaaactcatcacagtgattattctttctttctctgtattatgttttgtatctgtcttttgaagaatttattwtttttttt

SEQ ID NO: 461 - DNA, 830 bp, Arabidopsis thaliana
  misc_feature (1)..(830): Ceres CLONE ID no. 27878
  misc_feature: Encodes the peptide sequence at SEQ ID No. 348
aaagaaagctcagttagctattttctctaccacagaagaatctagacccagagagagagagagagagagatcagtaacgagagagtcaaagagaggagatttcagtgaagatgaaggagatgcaggcaatagagacgtcgcagccgacgacggtggctccggcggtgcatagccgacaattgggagctcagttgtcgggaagtatgagtttcagcagccaaatgtcgaaggaagatgaggagatgtctagaactgcgttatctgcgtttagagcgaaagaagaagagatcgagaagaagaagatggagattagggaaagggttcaagctcagcttggtcgtgtcgaagaagagactaagcgtcttgctttgatccgtgaggaacttgaaggattagctgatcccatgaggaaagaagttgctatggttaggaagaagattgattctgtcaacaaagaattaaagccattgggccatacagttcagaaaaaggaacgagagtacaaagaagctcttgaagcattcaacgaaaagaacagggagaaggtgcagctaatcaccaggctaatggagttggtgggagaaagcgaaaagatgagaatgaagaagctggaagagctaagcaagaacatagattctatacactgactttgaatccaagacagtacaagaacttcttgggccagagatcattctctgagtgttttaactctacgtttaggtttggtggtggtgaatgtaatttatattttataatcgtcgtgtgttatattactactacaattattatctttgttaggggttcttggagaatttataagtgtaatgtgg

SEQ ID NO: 462 - DNA, 931 bp, Glycine max
  misc_feature (1)..(931): Ceres CLONE ID no. 1646533
  misc_feature: Encodes the peptide sequence at SEQ ID No. 351
aagaagcgcactcgcaacaggggaaggaagcagagcactgcagcctcatcatttcaaggccaacacaaagcagagaaagcaaaaaaaaaaaagagagggttagagagataataaagtgaaggaagaagaaagggtttgtttgtgtgaaagaaaggatgcagagtgagaaccagaacaaccagctggtagtgcagaattcggggagcctgagcttcagcagccatttgtcgaaggaagatgaagagatttcacggtctgctctctccaccttcagggcaaaggaggaagagattgaaaggaagaagatggaggtcagagaaaaggttcagcttcagcttggtcgtgtcgaagaagaaactaagcgtcttgcaaccattcgtgaggagcttgaagccctggcagatccaatgaggaaagaagttgcgcttgttcgaaaaagaattgattccgtaaacaaagaattaaagccactgggtcatacttgccagaagaaggagaaagaatacaaagacgcccttgaagcttttaatgaaaagaacagggaaaaagtacagctaatcaccaagttaatggagttggtgagtgaaagtgaaagattgaggatgaagaagctggaggagctgagtaagaacatagattcgatacaatgatttagccaaactgctaatgactcctgattagccttgtgtggtatattaaagatgatgacatagtatattttatatgtatgggtgttttgttttgtgcttgtgtaattttgtggtgttgatgtttgtttaactagcatttgatgggacaatcagctaatttaggagggctatataccctacagacaggcaggcttgtaactaaacacttgcgttttgttgtcattttttctcccttcaattcacttttctttgctttgttctcttaaaaaaaaaaaaaaaaa

SEQ ID NO: 463 - DNA, 777 bp, Zea mays
  misc_feature (1)..(777): Ceres CLONE ID no. 359934
  misc_feature: Encodes the peptide sequence at SEQ ID No. 355
actactaccaatttcttacacggcttagggcgcaagaggcctctcctgctctacacactgccctagctagccgtttggagggcagcgttggcagctagcagcgacgacagatggagtgcagcggcaaggaggagcagcagatgcagatcgtgtgcgtgcgcagcgcgtcgacgggcggcggcgaggaggtgggggagtgggcggagcagtcgtcgcggtcggcgctgtcgctgttcaaggagaaggaggaggagatcgagcgcaagaaggtggaggtgcgggacaaggtgttctccatgctgggccgggtggaggaggagaccaaacgcctggccttcatccgccaggagctggagctcatggccgaccccacgcgccgggaggtcgacgccatccgcaagcgcatcgacaaggtcaacaggcagctcaagccgctcggcaagacgtgcctcaaaaaggagaaggagtacaagatgtgcctcgaggcctacaacgagaagaacaacgagaaagccacgctggtcaacaggctgttggagctcgtaagcgagagcgagaggctgcggatgaagaagctggaggagctcaacaagacgatagaatccctctattagatctgatctcacggaagaagaggatgacgatggtggtaacgtagtcgtggtatttcggcccataagagaaatcgaactagcaatgactgaagctcaacgtgcaaatttttttttctgcgacgtacttgatgattggatttgtgtatttgtacacgtgatttgc

SEQ ID NO: 464 - DNA, 936 bp, Zea mays
  misc_feature (1)..(936): Ceres CLONE ID no. 294598
  misc_feature: Encodes the peptide sequence at SEQ ID No. 356
aaagagagaatagctaggccgcgccgacgccgaaccgcagcagacacgcgcgcggacagcgtacgagggagggagctgcctgaggtagaggaggaggagaacatgcagggcggcggcggcgtggaccagccgccgatgcagatggtgctgcgggtgaggcacccgtcgtcgctgggcggcagcggggcggacgaggacgacggcgaggggtcctctaggtcggcgctctcggtgttcaaggccaaggaggagcagatcgagcggcgcaagatggaggtccgggagaaggtgttcgcccacctcggacgcgtcgaggaggagtccaagcgactcgccttcatcaggcaggagcttgaagggatggccgaccctacaaggaaggaggtggagtcgataaggaagcggatcgacacggtgaaccgtcagctcaagcctctcagcaagagctgcgtcaagaaggagaaggagtacaaggaggtcctggaggcgtacaacgagaagagcaaagagaaggctctgctagtgaacaggctaatcgagcttgtgagcgaaagcgagaggatgcggatgaagaagctcgaggagctcaacaagacggtcgactcgctctactagacgccagtcggtgctccgtgctctgctcacccacctctccatccactcatccatccagagcttgcacgctcgccctctgtaatctgatccccgtgtgccgtggattcgtgacctgttcaaggtggtgcttgtagtaactgatgtttttcgttgggtgatccttttctcttctttttttcttcttctctctttggtctcttttatttcaccagttcgtacgagtctcgttgcactgtcattgtcgagtaaaactgacgtactgtatttataagcaacaaacaggtaccagctgctgtctaaccacgttttgatggttcattc

SEQ ID NO: 465 - DNA, 752 bp, Triticum aestivum
  misc_feature (1)..(752): Ceres CLONE ID no. 839270
  misc_feature: Encodes the peptide sequence at SEQ ID No. 357
  misc_feature (656)..(656): n is a, c, t, g, unknown, or other
aagatataggaagaagagagaatactactacgccaactagtagcaactcaagagtcgattgattacgttacgtgacgtgcgtcgatcgatccataggaaggaagggaggaaggaagggaggaaggatagtaagatgcagggggaggtggagcaacagcagcaggcgccgatgcagatggtgctgcgggtgaagcacccgtcgtcactgtccagcggcagcgaggaggcgtcagagggggaggggtcgtccaggtcggcgctctccgtgttcaaggccaaggaggagcagatcgagaggaagaagatggaggtcagggacaaggtgttcgcgcagcttggccgcgtcgaggaggagtccaagcgcctagcattcatacgacaggagctggaggggatggccgatcctaccaggaaggaggtggaatcaatacagcggcggatcgacaccgtcaaccgccagctcaagcctytcagcaagagytgsgtcaagaaggagaaagaatmcaaggagattytcgaggsgtacaacgagaagagcaaggagaaggccatacttgtcaacaggctaatagagctggtgagcgaaagcgaraggatgaggatkaagaagcttgaagagctcaacaagrcagtcgattcmctcyattagttagacngtaataataatgttaattaccacccccgagagcttaatttcgctgtgcaatytctgtccgtcccatggatttgaatgtatgtgatctgtacgygtc

SEQ ID NO: 466 - DNA, 479 bp, Brassica napus
  misc_feature (1)..(479): Ceres CLONE ID no. 1123542
  misc_feature: Encodes the peptide sequence at SEQ ID No. 360
aacaaagctccggcgccacaccactaaacgcgaatctaactcttatctttgcgaattttcacggtttttggaaatggcgacagttccaggacagttgatatgggagatcgtcaagaccaacaactgtttcttggttaaacagttcggaagaggcaacgccaaggttcagttcagcaaggagaccaacaatctctgcaacctcaactcctacaagcactccggtcttgcaaacaagaagacagtgaccatccaggcagctgacaaggaacaaggtgttgtcctcgccaccaccaagaccaagaagcagaacaagcctaaggtctctgtcaacaagtctatccttaagaaggaattctcacggatgtccaaggctgttgctaaccaggtggtagacaactactacaggccagacttgaagaaatttgctcttgctagactcagtgtcatcagcaaaagccttagggtcgccaagtccggtg

SEQ ID NO: 467 - DNA, 638 bp, Arabidopsis thaliana
  misc_feature (1)..(638): Ceres CLONE ID no. 9083
  misc_feature: Encodes the peptide sequence at SEQ ID No. 361
agctccggcgccaccattaaaatctctcgatctctatctgcgaaatttcacggtatttgaaatggcgacagttccaggacaattgatctgggagatcgtgaaaaacaacaactgtttcttggtgaagcagttcggtagaggaaactctaaggttcaattcagcaaggagactaacaacctcaccaacgttcactcttacaagcactctggtcttgcaaacaaaaagactgtgaccatccaggccgctgacaaggaccaagctgttgtgctcgccaccaccaagaccaagaagcagaacaagcctaagctctctgtcaacaagtctatcctcaagaaggaattccccaggatgtcaaaggctgttgctaaccaggtggtggacaactactacaggccggacttgaagaaagctgcacttgctagactcagcgccatcagcaaaggtctcagggttgccaagtccggtgccaagcaaagaaacagacaagcttaagcttcttctttcacaatctgttttttttgaagtaaaagattttgttgaacaggttttatttaagtttgttgctttgaaagttgaaccataatgctattctccttttttcattatcccttattataaaggaggttagaagtttatc

SEQ ID NO: 468 - DNA, 750 bp, Arabidopsis thaliana
  misc_feature (1)..(750): Ceres CLONE ID no. 265408
  misc_feature: Encodes the peptide sequence at SEQ ID No. 363
ccggcgccaccattaaaatctctcgatctctatctgcgaaatttcacggtgagcttagtattactctcaattgttctcagtaggtatttgaaatggcgacagttccaggacaattgatctgggagatcgtgaagaacaacaactgtttcttggtgaagcagttcggtagaggaaactctaaggttcaattcagcaaggagactaacaacctcaccaacgttcactcttacaagcactctggtcttgcaaacaaaaagactgtgaccatcccaggcccgcttgacaaggaccaaagctgtkgtgctcgcccmccmccaagaccaaagaagcaagamcaaagcytaagytytctgtccamcaagtctatcctcaagaaggaattccccaggatgtcaaaggctgttgctaaccaggtggtggacaactactacaggccggacttgaagaaagctgcacttgctagactcagcgccatcagcaaaggtctcagggttgccaagtmcggygmcaagcaaagaaacagrcragcktaagcttcttcgtttcacwatctgttttttytgaagtaaaagattytgtygmacagrttktatktaagttgttgcttwgaagwtgwwccataatgctattctccwttttcattatccttattataaaggagttagaagtttatcttgtctatgcttgatgtttctggwgtgcttgtgcttacatyktgttagawccttmtatmgaatcargarctttctc

SEQ ID NO: 469 - DNA, 646 bp, Arabidopsis thaliana
  misc_feature (1)..(646): Ceres CLONE ID no. 32164
  misc_feature: Encodes the peptide sequence at SEQ ID No. 364
ccggcgccaccattaaaatctctcgatctctatctgcgaaatttcacggtaggtatttgaaatggcgacagttccaggacaattgatctgggagatcgtgaagaacaacaactgtttcttggtgaagcagttcggtagaggaaactctaaggttcaattcagcaaggagactaacaacctcaccaacgttcactcttacaagcactctggtcttgcaaacaaaaagactgtgaccatccaggccgctgacaaggaccaagctgttgtgctcgccaccaccaagaccaagaagcagaacaagcctaagctctctgtcaacaagtctatcctcaagaaggaattccccaggatgtcaaaggctgttgctaaccaggtggtggacaactactacaggccggacttgaagaaagctgcacttgctagactcagcgccatcagcaaaggtctcagggttgccaagtccggtgccaagcaaagaaacagacaagcttaagcttcttctttcacaatctgttttttttgaagtaaaagattttgttgaacaggttttatttaagttgttgctttgaagtttgaaccataatgctattctcctttttcattatccttattataaaggagttagaagtttatcttgttatgcttg

SEQ ID NO: 470 - DNA, 681 bp, Brassica napus
  misc_feature (1)..(681): Ceres CLONE ID no. 1068047
  misc_feature: Encodes the peptide sequence at SEQ ID No. 365
aaaagcttcggcataatcaccattaaacccgagtctatacctctctctctctctcactcacggttttgaaaaatggcgacagtaccaggacaattgatatgggagatcgttaagaccaacaactgtttcttggtcaaacagttcggaagaggcaatgctaaggttcagttcagcaaagagaagaacaatctctgcaaccttaactcctacaagcactctggtcttgcaaacaagaagacagtgaccatccagccagctgacaaggatcaaggtgttgttttggccaccaccaagaccaagaagcagaacaagcctaaggtctctgtcaacaagtctatccttaagaaggaattccccaggatgtccaaggctgtcgctaaccaggtggtggacaactactacaggccagacttgaagaaattcgctcttgctagactcagtgtcatcagcaaaagcattagggttgccaagtccggtgccaagcaaagaaaccgtcaagcttaagcctttttcaagtactgaagacgtttattaagttgttttttgttgaactaccttaacactatgctatgcttatccttttcaaaagatgttagaactttttttatttattatgcttttggtttctggtgtgcttgtgttggatctttttttttataaaatcaaggagttgatcatgtg

SEQ ID NO: 471 - DNA, 708 bp, Brassica napus
  misc_feature (1)..(708): Ceres CLONE ID no. 965035
  misc_feature: Encodes the peptide sequence at SEQ ID No. 366
aaaaagcttcggcataatcaccattaaaccgagtctctctctctctctctctctctctctctctctctctctgaactttcacggtacgttttggaaatggcgacagtaccaggacaattgatatgggagatcgttaagaccaacaactgtttcttggtcaaacagttcggaagaggcaacgccaaggttcagttcagcaaagagaagaacaatctctgcaaccttaactcctacaagcactctggtcttgcaaacaagaagacagtgaccatccagccagctgacaaggaacaaggtgttgttttggccaccaccaagaccaagaagcagaacaagcctaaggtctctgtcaacaagtctatccttaagaaggaattccccaggatgtccaaggctgtcgctaaccaggtggttgacaactactacaggccagacttgaagaaattcgctcttgctagactcagtgtcatcagcaaaagcattagggttgccaagtccggtgccaagcaaagaaaccgtcaagcttaagcctttttgaagtactgaagaggtttattaagttgttttttgttcaagtcgaaccttaacactatgctatgcttatccttttcaaaagaagttagaacttttttttatttattatgcttttggtttctggtgtgcttgtgttggatcttttttttatcaaatcaaggatttgatcatgtg

SEQ ID NO: 472 - DNA, 708 bp, Glycine max
  misc_feature (1)..(708): Ceres CLONE ID no. 557065
  misc_feature: Encodes the peptide sequence at SEQ ID No. 371
attcctctgcattcattcagcgttcatctcaatctagatttgtgtgcggtgcgtctccggtgaagagaagaagatggcgaccgtaccaggacagctcatatgggaggtcgtaaagaagaacaactctttcttggtgaaagagttcggaaggggcactcagagcgtgcagttcagcagagagcccaacaatctctacaacctcaacactttcaagtactccggtttggcgaacaagaaaactgtcactgttcaacctgcgggtaaagaccagtctgtgttgctggcaacaaccaagacaaagaagcaaaacaagcctgctgctttgcttcacaaatctgtcatgaaaaaggagttccggaggatggcaaaggcagtgcaaaatcaggtagcagataactactacaggcctgatctcaaaaaggcagctctggcaaggttgagcgctgtcaataggagcctcagagttgctaagtctggtgtgaagaagaggaacagacaggctgtgaaggtccctagcaggaagtgaaattagaagagttaaattgcattctacattactaccatccttttcccccttttgtagtttgtgttccagaaccaaaatttagattttcgagttttgtttggaraggcaattattgtgagttttcaatatacaacaactggaactatgttatagctttcaactgggttggtattttttttttt

SEQ ID NO: 473 - DNA, 630 bp, Glycine max
  misc_feature (1)..(630): Ceres CLONE ID no. 465060
  misc_feature: Encodes the peptide sequence at SEQ ID No. 372
ggtcttgcaggcgaagagatggccaccgttccagggcagctcgtgtgggagatcgtcaagaaaaacaattccttcttggtcaagcagtttggaaggggcacccagagcgtcgaattcagcagagagagcaacaatctctacaacctcaattcgttcaagtactctggtttggcaaacaagaaaactgttactgttcagcctgagggcaaagatcaggctgtgttgttggctacaaccaagacaaagaagcaaaacaagcccgctgcattgctccacaaatctgtgatgaagaaggagttcaggaggatggcaaaagctgttgaaaaccaggtggccaaaaattactacaggcctgatctcaagaaggctgcccttgcaaggttgagtgctgttcacagaagcctcaaagttgccaagtctggtgtcaagaagaggaatagacagggcgtgagagtcgctggtaggaagtgaaagggaattgagaaagaatctgctgttcaatcttcgtttttgccctctctttcgtgtttttagaactccaatctagatttctcgagtttgttttgcaatgcagttatttattaagtattcaatatgaaaacttgaactaccaaaaaaaaaaaaaaaaaa

SEQ ID NO: 474 - DNA, 570 bp, Populus balsamifera subsp. trichocarpa
  misc_feature (1)..(570): Ceres ANNOT ID no.  1488311
  misc_feature: Encodes the peptide sequence at SEQ ID No. 96
tgaaggttgtagccgcttacttgctcgccgttctcggtggcaacacctgccctaccgccgaggacttgaagcacatcctcggatctggtaatctcttctttccctctccacattatgttttccttttcccgttattagatccttatatctttttttggaaaaatgatcggttttttggtttttggatttgcagttggagcagatgctgatgatgacaggattgagctgctgttgtccagtgtgaaaggaaaggacataactgagctgattgcttccggaagggagaagttggcttccgtcccttccggtggtggcgttgctgtcgctgccggtggagctccagctgctgcttccggtggtgctgcccctgctgccgaggcaaagaaagaggagaaggttgaagagaaagaggagtctgatgatgtaagcgccatttttcattttcgttttttgttgtatttatgaaattgatttttatttggcttttgctctgttggtattaagttttttgactgactggatattttgttactgttgttgcaggatatgggtttcagtctattcgattaa

SEQ ID NO: 475 - DNA, 2999 bp, Populus balsamifera subsp. trichocarpa
  misc_feature (1)..(2999): Ceres ANNOT ID no. 1465437
  misc_feature: Encodes the peptide sequence at SEQ ID No. 109
tggtctatgtatataatttttttttaaaaaaaaaatatctaaacgaatagcaggtaaatatatagatttttcttgcatgactatatatattatattcacgtattcttctctggatcccgaagtcacgaaagtactcaaaatgatttgtatgcttcatatctggggctagtacaagtaaacgaacgcgttagcctttgaattaactccttttagtctctggaattgcaaattctatatggctagctgtagcttgtcttccccaaacattacacacaagtccacagattttcttcgttcttgcaagaaaacgcagcctgttcaaattaagcttggaagataaaaactcaagagacacgataaagaaggtgatcacggaggaggtgaggaggaatgtcagtgttgtggtggatgtttgaatagatcgttgctgaatctctgttacatcgtcctgcaaagatctctcaaggaaaggagacaccgaggaagttcaaaaggacatggcttgtgcagatcatcgccaggtgagagatcaacgaagaatgtgattaagcattatttgattttgatgcatcattgtatctaagccaaatgcacttatggcaagaaactaggagcatggattggagaagaaactcatggaacaaatgtcaagcctcatcttgcaagtgtaattaatttatattaatattcaataaattagtaatctcgattaaataatatttttattttatatcaacttaaatttaaaatttaaatgatatcttaattaaaaagttttcatgctatcatggatattaatttatagaggtttaactgtaatttcattcaaatttactttaactacaaatgattaataaattagattcatatgcaataaaataatttatttcgactttttaatttctactatttattttcataaaaagtttaataatttaatttatgagattcatttattcagcatataattttttttttaattccatgagatgcttgaaatgggaattcaagaataatatttgttaattaaaattagcattgatgacacaaattaaaaaaaaaaaaacccatgtccttgtgcatagcggaaacgtgcaaaggaagttactttaaacgactaaccaggcatcataaaaccctaaccctgactctattaacaccccatcaaaaccctaactttcacacggttttcttctttctctgaagatcaaagaaaaaaccctcaaaggtaaaatctttctctgccttttactttgcaatacggcaaacccttattgtatcatactctaatttgtttgcctttgttgaaatctagaggaaaaggaaagaaagaaacaatgaagactgttgctgctttcttgttggctgttttgggtggcaacaatagcccttctgctgaagatatcaagaagattcttgcctctggtatatgctctttattgtttatatttttctttttggcttgaaagatgaaatctttgttttcttgtttttttgtttttttttaaagaagaaatcttgaaaggcaagtaataagaaatcttgggatttttaaaaaattaatcttgtgttcagtttggatgatattattccggggaataaaagaatgaccagaaaattaaaaacccattataaattatgttaaagttttttttccctgtttgggataaaaaaacaggggattagctagtttttttcacaatgttgtatgtgatatgctataatgtgtgttgatgttgtgtgttatggcatgaaaagtttagattggatgcgtgcctgttgatttgcctactaaattaggcataaaaacgggttgtgttgttggttcatctttttttttctgatttgtgctttgaatatatctaactgtaagggatttaggttctgaaagtaatgtatgttttgtgctagatagagaatattgtatggaaggatttttgtggcttttgtgttttgacacaagggatacggagattgtgccgtccgaagaaacttgattttaaggtcaataggactgatttgtatgcttgtgttctactctgaattgaatcttaatctgggttatgtagcggattacctcatgcttagagtttgtttttatattttaaaaatatttttttatatgaaaatatataaaattgatagttttaagtatattctgaataattttaatgaactaatgttaaaaataatatatatatcattttaatacattttcaaataaaaaaatatcatattacttgaaaatatccttcttgtttcttattaaacttgttttttatacttgtatctttaattctatttttcttaatttgaatctttttttttttaattgggtgtatctctttgattaattttgtatagtactatctgaattctttctcctttctttttgaaaggaaaaacaaaatgtgaattttcagtcacaaaagccaaaactcaggacaaaatggacgtttatggaaataattaggctttttcaggttttgaatgctttgaaatatggtttgcagttggtgctgaagctgatgataagattgagctactcttgtctcaagttaaggataaggatataactgagcttattgctgctggaagggagaaattagcttctgtgccttgtggtggtggcgcagttgttgcagcggctgctccagctgatggcgctgctgctcctgctgctgctgagacaaaagaggagaaggtagaggagaaagaggatacagatgatgtaagtcaacatccttcttaaggccagattactagatttacaagtagctaattgttttgctgaatattttttttttattccactccatctctattttcaattcttttgatctggtacctcctttctattcgtgcattcatgtctagtcggttcatcatgtagatcatctggttattgttatgcatgcaaatattatttaattgctagtgcactgatgttccttatgtttcattccttgcaggatctgggcttcagtctctttgattga

SEQ ID NO: 476 - DNA, 515 bp, Populus balsamifera subsp. trichocarpa
  misc_feature (1)..(515): Ceres ANNOT ID no. 1481954
  misc_feature: Encodes the peptide sequence at SEQ ID No. 118
tacccagtctaggtcatgaggctcttcataaatctactatgaaaactcatgtccatgaagaagaagaagaaaaataactaactaactattaataataatagttcaagacaaacctaacggtctaaaaaaaattttagcatgtccgtacaccacgaaggaggacttcagcgatttgaagagtaattcttagcggaagagagacttcattcaagaaggggggcctaaaaatcccaaaaaaaaaaaaaaacattaactttagtgataatttttttatttttatttacaacaataaattaataaacaacgaactattaccgatgacattcaattaactttcttaatgcctacgctaatactatttaaaataaaaaactcatcttactcaccgctcgctaacctcaagtcgtctcggctcccacccaggtaatacgctaagtagcgggcctcggtgtgtagtacgacaagtcctccggaaacttaatagtcgtcgtcgtcctagttcgagaacagttcac

SEQ ID NO: 477 - DNA, 3221 bp, Populus balsamifera subsp. trichocarpa
  misc_feature (1)..(3221): Ceres ANNOT ID no. 1440705
  misc_feature: Encodes the peptide sequence at SEQ ID No. 142
tgggtactcaagttcctgataatcaaaaacctgatgtccccgaggaattatcagaagtatgtccctctcctgtcctacacaacaacatgttttcatctggaatgatagctagactctacaatgtgaagttacagcaggctttgtttgtccattaggatcttacctcttcttgtaacagaaatatttctgctgagctatgctaggatgcaggataacaaagttattagaagcaaaaataggaggttactttacatacaatatgccttaggatagtgcaaatcatgttagcttgtggaaccaagatcctgagtctgtgatcaatcaacaaatcatagtcatgaaccttttttttattttctggaatatctatctagcatgtacttggaattggattactcaatttttaacactgcagttttgttattgaaagtaacaaggagatgtgatattgtgaatgacaggcagatagaaggaagaaagagattgatgattggcttccaatcacttcctcgagaaatgcaaaatggtggtattcagctttccacaatgttacggccatggttggagctggtgtcctcagtcttccatatgcaatggcaaatcttggatggtatgtgtcttcgtcagcatcgtcgtgaaattgcctgattcatatttgtccttaaatctttaaatttttctagaaaatggaattagtcttaatctgtgacagcatgattggtaattcaggtctttttcatctttgattccaggggccctggtaccgtaattcttgtgctctcatggaccatcactttgtacaccctatggcaaatggttgagatgcatgagatggttcctgggaaacgatttgaccgataccatgagcttggccagcatgcctttggtgaaaaacttggtctttacatagtagtgccccagcagcttatttgtgaagtaggggttgacatagtctacatggttactggaggaaaatcacttcagaagatccacaatttagtgtgcaaagactgtgcaccgatcaaattaacctactttatcatgattttcgcctcggttcatttcgtgctttctcatcttcccaactttaactccatctctggtgtttcactggctgctgcagtcatgtctttgaggtatgttggccgcaagtcaattcaccaccctctttgatttgcaatacataattctaaattctctgctggaaaattgaagaggataggatggaaatgagagggacgaattgcttaaatgatttctagaaattaatcaatgaggcaaccgtttagcataatccattatgaattcgaaaaataacgatcagcttagccagagactgcagcctcctgtgttataaatgaaaagcattcctacagggtacacctaatgcaacagagaattcttaaagagtcacaggaattcatttacttcttgttttgtactttctaattgatggtgaccaaacacaatcgtgtttggtgtaatgaatcttttgcagttactctaccattgcatggtcagcttctgtccacaaaggtgttcagccagatgtcgactatggctacaaagcctcgacaacttctggaacggtcttcaatttcttttctgccttgggcgatgtagcttttgcctatgctgggcacaacgttgtgttagagattcaagcaacaattccatctaaaccaggcaagccatcgaaagggccaatgtggaaaggagtggtggttgcctatatagttgtagcattgtgctacttcccagttgctctgatagggtattacatgttcggtaataaagtcgaagataacatactcatatcgttagaaaaaccaacatggctcatcgtagcagctaacatgttcgtcgttatccacgttatcggaagctatcaggtttgatttgatgcagttgatcatgtctcatgagcagttcaatcaccatgatagcaaaactaacatgaatttgtcctgaattttttttttattattattttgtttctgttgtacaacagatatatgcaattccagtatttgacatgctagaaacattgctggtaaagaagttgcatttcaggccttccagaaagcttcgattcattacacgcaatatatatgttggtgagtaaatttcaccagtgttgtcacttcggaagtgtctggtttaattcgtataaactgagacttcgattttgatttcagcgtttacaatgttcgttggcatctgcttccctttctttggtggtcttctgggattcttcggaggatttgcttttgccccaacaacttactttgtaagcactagtttcttgtcctgtgcaataaaaaatgaaatttaattgcagaaatttcttgtttagtttacggacttttcaaggatgcttcagttcaaattcctgaatctctttcctttcattttcagctaccttgtatcatgtggctggccatctacaaaccaaagaggttcagcttatcatggatcaccaactgggtatgctcaatgcttaatttttcacaccacactttgatatgcttttcatctcctcaaacctgatcctgctttctccatttcagatctgcattatacttggctttttattgatgattttgtcacctattggagggttgcggactatcatactaaatgccaagggctacaaatttttctcttgatcaatcctcacacaactcagtgtaaattctgagaactatattagactggcgccctgtagctgtattaaaaataagatgtctttgacaataagtcaggctcagtttgtgcagaagtcattgctgatcggtaggtattgtcttttccagtgtccagcaatgttgttttcaagccttgccacagtttgtgttttatttgaactacagttgccttgcattttgcgtgtcagcagaacataatcttattatttgtttttggtaaacaagtgtctggatttgaggactaaccttgtctcggattctttgtttcctatgaaacgccatggaaggaattctggagtcactttaatatcatcaacattttgcataggtcttggaggtcatgattcctcgctgtcattctcacaactcatctctcgtggttttggaagagcttactcgtgcaatgtagacatcttagttcgatttccactctacaatttctctgaaccatgcttcaagattgttgtatggtatagggaattttctcaccaaaagctactgttgaagagttaa

SEQ ID NO: 478 - DNA, 2669 bp, Populus balsamifera subsp. trichocarpa
  misc_feature (1)..(2669): Ceres ANNOT ID no. 1493584
  misc_feature: Encodes the peptide sequence at SEQ ID No. 144
tgggtactcaagttcctgataatcaaaaacctgatgtccccgaggaattatcagaagtatgtccctctcctgtcctacacaacaacatgttttcatctggaatgatagctagactctacaatgtgaagttacagcaggctttgtttgtccattaggatcttacctcttcttgtaacagaaatatttctgctgagctatgctaggatgcaggataacaaagttattagaagcaaaaataggaggttactttacatacaatatgccttaggatagtgcaaatcatgttagcttgtggaaccaagatcctgagtctgtgatcaatcaacaaatcatagtcatgaaccttttttttattttctggaatatctatctagcatgtacttggaattggattactcaatttttaacactgcagttttgttattgaaagtaacaaggagatgtgatattgtgaatgacaggcagatagaaggaagaaagagattgatgattggcttccaatcacttcctcgagaaatgcaaaatggtggtattcagctttccacaatgttacggccatggttggagctggtgtcctcagtcttccatatgcaatggcaaatcttggatggtatgtgtcttcgtcagcatcgtcgtgaaattgcctgattcatatttgtccttaaatctttaaatttttctagaaaatggaattagtcttaatctgtgacagcatgattggtaattcaggtctttttcatctttgattccaggggccctggtaccgtaattcttgtgctctcatggaccatcactttgtacaccctatggcaaatggttgagatgcatgagatggttcctgggaaacgatttgaccgataccatgagcttggccagcatgcctttggtgaaaaacttggtctttacatagtagtgccccagcagcttatttgtgaagtaggggttgacatagtctacatggttactggaggaaaatcacttcagaagatccacaatttagtgtgcaaagactgtgcaccgatcaaattaacctactttatcatgattttcgcctcggttcatttcgtgctttctcatcttcccaactttaactccatctctggtgtttcactggctgctgcagtcatgtctttgaggtatgttggccgcaagtcaattcaccaccctctttgatttgcaatacataattctaaattctctgctggaaaattgaagaggataggatggaaatgagagggacgaattgcttaaatgatttctagaaattaatcaatgaggcaaccgtttagcataatccattatgaattcgaaaaataacgatcagcttagccagagactgcagcctcctgtgttataaatgaaaagcattcctacagggtacacctaatgcaacagagaattcttaaagagtcacaggaattcatttacttcttgttttgtactttctaattgatggtgaccaaacacaatcgtgtttggtgtaatgaatcttttgcagttactctaccattgcatggtcagcttctgtccacaaaggtgttcagccagatgtcgactatggctacaaagcctcgacaacttctggaacggtcttcaatttcttttctgccttgggcgatgtagcttttgcctatgctgggcacaacgttgtgttagagattcaagcaacaattccatctaaaccaggcaagccatcgaaagggccaatgtggaaaggagtggtggttgcctatatagttgtagcattgtgctacttcccagttgctctgatagggtattacatgttcggtaataaagtcgaagataacatactcatatcgttagaaaaaccaacatggctcatcgtagcagctaacatgttcgtcgttatccacgttatcggaagctatcaggtttgatttgatgcagttgatcatgtctcatgagcagttcaatcaccatgatagcaaaactaacatgaatttgtcctgaattttttttttattattattttgtttctgttgtacaacagatatatgcaattccagtatttgacatgctagaaacattgctggtaaagaagttgcatttcaggccttccagaaagcttcgattcattacacgcaatatatatgttggtgagtaaatttcaccagtgttgtcacttcggaagtgtctggtttaattcgtataaactgagacttcgattttgatttcagcgtttacaatgttcgttggcatctgcttccctttctttggtggtcttctgggattcttcggaggatttgcttttgccccaacaacttactttgtaagcactagtttcttgtcctgtgcaataaaaaatgaaatttaattgcagaaatttcttgtttagtttacggacttttcaaggatgcttcagttcaaattcctgaatctctttcctttcattttcagctaccttgtatcatgtggctggccatctacaaaccaaagaggttcagcttatcatggatcaccaactgggtatgctcaatgcttaatttttcacaccacactttgatatgcttttcatctcctcaaacctgatcctgctttctccatttcagatctgcattatacttggctttttattgatgattttgtcacctattggagggttgcggactatcatactaaatgccaagggctacaaatttttctcttga

SEQ ID NO: 479 - DNA, 2074 bp, Populus balsamifera subsp. trichocarpa
  misc_feature (1)..(2074): Ceres ANNOT ID no. 1463076
  misc_feature: Encodes the peptide sequence at SEQ ID No. 146
tacggtaggttactcagtgtcttgctacttcgtcgttctcttttccggtatttactaaccgaaggtcagtgaaggagctccttacggtttaccaccatgagttggaaggtgttacagtgacggtaccaaccacgaccacaagaatcagaggggatacggtaccgagttgaacctaccatacatagatatttatatacgaattagaattgaaataatatatatgtatctagttatatacatactcgaattgatgattaattaagaaacaagacgtaggtactttaaaatcccctggtccacaacggtatgaaaaaaatagtacccactagtgcaatatgtgagataccgtttaccaactttacgtactctaccaaggaccattcgctaaactatctatggtactcgatcccgttgtacgcaaacctctcttcgacccagagacctaacaacacggtgtcgttgatcaacatgttcaacctcatttgtatcagatataccaatggcctccttttagtaacttcttcaaggtactaaaccaaacgaggctgacgtttctgtagtccgattgcatgaagtagtactaaaagcgaagcgaagtcaaacaagaccgagtagaagggttagagttgaggtaatcacaatagagagaccgacgtcgtcagtacaggaactccatgcgtggatcgatgagttaagcggagtgataaactagtcaaattagatatatgcatatattaggttctgggagaaaaaatatgcctataccgccactaacgtagtacgtcaatgaggtgttaacggacccctcggtgggaattattcccacaagtcggactacagctgatgtcgatatttcgctcgtgattttggcctcgacagaaactgaaaaagagacggaacccactatatcgaaaacgtatacggccagtgttacactagaacctctaggttcgttgttaagggagatgaggtctcttcggaaggttctttgggtacacctctcctcggaaggaacgtatacaacagcagcggtagacgatgaagggtcaacggaactaacctatgaccaaaaaacctttgtcgcaccttctgttgtaagaatagagtgagctctttggtcgaaccgaataacgttgacgattgtacaaacaacagtaagtacaataaccttcaatagtccacgcaaaatgaagaaaaaaaaggaaccaattaagtcaaagccagctaaggtcgcggatgacgtacgtgtgtatgtacatataactgagtactacgtacaaagttagacgtctatatacgataccgtcacaagctgtacaacctttgacgtaaccacttctttgaggtaaaaagaggaagaaagtacgaagcgaaacaatgagcgtgccatatacaaccattcacgtcgaaggtccggtgagataaaaagaaagtcgatggataagacttgcggagacgttcaaacatggacgtcgaaacccgcgagttagagaagaaacttataacaaacgacgtcccaagtgttactaacaaccatatacataaggtaagaagccaccggacgaaagcaagaagcctcctaaacgaaaacggggttgttgtatgaaacattcttgagtaatgattgggtcatatatatatatatatagtaaatggtgtatggacgaagtataaattcgatagtagtgactgtttttttagttgagaaatgtcgagggaacgtagtacaccgaacggtagatatttgggttcttcaagtcgaagagaacctatcgtttaacccacgcattcgaactgtaacaaatctttagttaatataattagaactccgaacgtactcgacttattaagtttttatataaagtccagacgtaacacgaaccttaaaacgactactataacagtgggtaaccacgggattctgtatagtaggaatgtcggtttctgatgctcaagaagagtactcgtagtgtggtttacgctctgttcccgtctggttcatgacatttctttcccacaactaactcaacgaccaataccggaaacgtgaatcgtcctttgagtttaaattaat

SEQ ID NO: 480 - DNA, 1964 bp, Populus balsamifera subsp. trichocarpa
  misc_feature (1)..(1964): Ceres ANNOT ID no. 1516369
  misc_feature: Encodes the peptide sequence at SEQ ID No. 149
tacggtaggttactcagtgtcttgctacttcgtcgttctcttttccggtatttactaaccgaaggtcagtgaaggagctccttacggtttaccaccatgagttggaaggtgttacagtgacggtaccaaccacgaccacaagaatcagaggggatacggtaccgagttgaacctaccatacatagatatttatatacgaattagaattgaaataatatatatgtatctagttatatacatactcgaattgatgattaattaagaaacaagacgtaggtactttaaaatcccctggtccacaacggtatgaaaaaaatagtacccactagtgcaatatgtgagataccgtttaccaactttacgtactctaccaaggaccattcgctaaactatctatggtactcgatcccgttgtacgcaaacctctcttcgacccagagacctaacaacacggtgtcgttgatcaacatgttcaacctcatttgtatcagatataccaatggcctccttttagtaacttcttcaaggtactaaaccaaacgaggctgacgtttctgtagtccgattgcatgaagtagtactaaaagcgaagcgaagtcaaacaagaccgagtagaagggttagagttgaggtaatcacaatagagagaccgacgtcgtcagtacaggaactccatgcgtggatcgatgagttaagcggagtgataaactagtcaaattagatatatgcatatattaggttctgggagaaaaaatatgcctataccgccactaacgtagtacgtcaatgaggtgttaacggacccctcggtgggaattattcccacaagtcggactacagctgatgtcgatatttcgctcgtgattttggcctcgacagaaactgaaaaagagacggaacccactatatcgaaaacgtatacggccagtgttacactagaacctctaggttcgttgttaagggagatgaggtctcttcggaaggttctttgggtacacctctcctcggaaggaacgtatacaacagcagcggtagacgatgaagggtcaacggaactaacctatgaccaaaaaacctttgtcgcaccttctgttgtaagaatagagtgagctctttggtcgaaccgaataacgttgacgattgtacaaacaacagtaagtacaataaccttcaatagtccacgcaaaatgaagaaaaaaaaggaaccaattaagtcaaagccagctaaggtcgcggatgacgtacgtgtgtatgtacatataactgagtactacgtacaaagttagacgtctatatacgataccgtcacaagctgtacaacctttgacgtaaccacttctttgaggtaaaaagaggaagaaagtacgaagcgaaacaatgagcgtgccatatacaaccattcacgtcgaaggtccggtgagataaaaagaaagtcgatggataagacttgcggagacgttcaaacatggacgtcgaaacccgcgagttagagaagaaacttataacaaacgacgtcccaagtgttactaacaaccatatacataaggtaagaagccaccggacgaaagcaagaagcctcctaaacgaaaacggggttgttgtatgaaacattcttgagtaatgattgggtcatatatatatatatatagtaaatggtgtatggacgaagtataaattcgatagtagtgactgtttttttagttgagaaatgtcgagggaacgtagtacaccgaacggtagatatttgggttcttcaagtcgaagagaacctatcgtttaacccacgcattcgaactgtaacaaatctttagttaatataattagaactccgaacgtactcgacttattaagtttttatataaagtccagacgtaacacgaaccttaaaacgactactataacagtgggtaaccacgggattctgtatagtaggaatgtcggtttctgatgctcaagaagagtac

SEQ ID NO: 481 - DNA, 2142 bp, Populus balsamifera subsp. trichocarpa
  misc_feature (1)..(2142): Ceres ANNOT ID no. 1501628
  misc_feature: Encodes the peptide sequence at SEQ ID No. 154
taccgcatattaggtttccaccattcgtaacaaaacaaacgatagacccgagagagatattgttattaaaaagaaggagcatttaaagtctttaaagttgacaagataaccaaaggctcagaaagaaaaaaattacaaaacaacaaacaagacaagtaaatacaacaagaaaggaattgacttattggtaaaaaaaaacaaagattgaaatatagggaggtaaagagagaagaagaagaagaagaaaagggagaaaaaacccaagaactaaaacctaatctgatacctaagcagaccacctctaccacctaacgagaatcttctttggtaccttcgtgtttttgagtgacaaaacctagcatatctacctaaagttatgtgtttcctctttagtctatcgaaataataactgtacctttcaaagagagtaccgtagttatttctatagttatgtttagtttcttagtgtcactcaaagacgaaaaagaaagaggaaaggaaagaagaagagaggaaaaagaaaacacctattaaacaaacatcaactaagtcgttgtgcgtacggtaatgttaggttacagaaaaacagtttagtagtaatagatatactaagaagaagaaaaaaatacttacttttcaacgtctccttggaaagttcttttcccagtggtgccccgccaccaccgccgccgctcttcttctaagtaagattagagagagtagaaacactatttctccgataacaacgaagtcgaagcgggtctccataatcaaaacgtaatgtttgagactattaaaacacacctccggtacaggtacaaccaacacgacagtaatactatcatatggacagtggtaaaagtctatctaaaaatcttttcgacatctatgacaacagagataagaagttactatttacctagaagatttttttaatgtatataaaatctgaccaactaaatatccactaagttatccaaaggttcaaaaaaataacaattaaacaaaaattggaaagtcctgtaaattcaacgcaaattaattaaaagatttttactatttatgttttctttatttttgtgtaaaccaattttatttttttgtctctgtatttttattaaaataaagtttttgtcaaaatcttatttaaatatataaaagttttggtagaaaaatcaggctctattattgatttaagattctacgttaagtgatcgtttgtaatcttcgttgtttaattctaacggtatgaataacaaataacactctttgtatctgatcattaaaagaaaagtagttagaggttgacgagatcaaaaccctcccatttaaggttaataatctcttgtcgaactacacatgatgactataaataagatcatcaaaaaaaggaatggaagaagttacacaacggtttggccgagactatccctctcgttctgtctaaatccaaattgaccacttccaatccaccggagctattcgatctcacacgtgtttttgtttgggagagatggtgacaattaccccggttataaatgtcaaccactttcactctacaatggtttgtcaacccagttggctttactttgtacccacccaaattaatttgtctttcatgtctaatgtctcgtagtaggtaaaacaaccagtgggaggtaacaacttccgtacacgtgaacaattcaactacttttacgatcgatgggtatttgtttacgaatgtggatatatcatatcacaaatgactagacattgacgaaattatcccggatcgtgcggacttttccgacgccaccattgccacccctggggtctagtaaggtcatcgggtgttcaagtagtagtttagtgatagtgctggccgtcgtagttaccgtggggtcttccgtctacgtaatcctctttgtcaaagttcgcgcgtagtggaaggacccaggaactagggttttcccaagaaaagaagaaacggtgtgacattcgaatggttgggaactttttcgacgtttttctagttagtatacagtactataaacaaatgtccgttaaataaaatccataaaagtaaacgttgtccagctcatacccttgttacaacgactatatggagtgagaaagttaacccttcgagttttgtctaac

SEQ ID NO: 482 - DNA, 2038 bp, Populus balsamifera subsp. trichocarpa
  misc_feature (1)..(2038): Ceres ANNOT ID no. 1519046
  misc_feature: Encodes the peptide sequence at SEQ ID No. 156
taccgcctattaggtttcaaccattcgagaaaaaaaaaaaaaaaaaaaagatgtgcccaaggagaggtattattagggaacatttaaagttttaaacgttcacaataaccaaaaactcagacagaaaaaattacaaataaaataccaaaatgaacaaacagaacaagtatgttcaacagaaaaagaagttgacttattgaatataaaaaggaaaggttagaaacccaagaactaaaacctaatcctatacctaagtagttcacttcgaccacccccaccaccgaagcgtaatcttcttgtgtaccttcgtgttttttagagtcagaatctagtatatttacctaaagttacgtgtttcctctttagtctatcgaaacaataactgtacctttctaagagagtgccgtatttatttctatcgttatgtttaagttcctagtgtcactcaaagaagatgaaaaagaaagtgaaaaggaaataagaagagagaaaagggaggaaaacagatgtacacctattaaaaagaacatcaactaagtcgttatgcgtacggtagcgttaggtaacagaaaaaacagtttagtagtaatagatatacgaaataactaaggttaccttctaatcattaaactagataaaacaaacttattaaaccaatggaaaaattactaaaacaaaacttacttttttcaacgtctcctcggtaaggtcttttcccagtggcgcccccccgcctccgccgctcttcttctatttaagattagaaagagtagaaagacaatcactatctctacgataacaacgaagtcgaagtggatctccatagtaaaaacgtaatctctgtgacttaaatcaaaacaccagtgcagtacagctaaaacgaagacaataggaatattattataggtacaacagtgaaacgaagttgatatcttctgagtaagttttattcataagatatttaaaaatctgttgagttaaaatatccctgaatcatcaaaaggtttaagagatagcaatcaaaacaaaaatgggaggacatgtaaatcaaatacgttaagtgttcgtttgtagtctttgttgtttagttctaattgtacgaaccacaataaaacatttttcaaaagtgattagagattatcgaggttaaaaccctcccatttaaggtagatactctcccgtcgaactacacgtgataactataaacaagatcgatcgggaaaaggaacggaagcagttgtacaacggttccactcatattatctctctcatactctttggatccaaattgacaacttccaatccacaggatctattcgttttctcataaacgagtcttgtttgggcaagatgatgacaattaccccggttatcaatgctaatcactttcactttacaatggtttgttaaaacagttggtacctcacaagttgttggctgaactttgttaccacccaaattgattaaattgtacctcatgtctaatgtctcgtaataggtaaaaaaaccaacaggtaacaacttccgtacacgtgaataaaaacctttcaactacttttacgatgtatggttttgtagtttacaaaatgtacatatatctgtaacataaatgattagacattgacgaaattatcccggatcgtgcggtcttttccgtcgccgccattgccatccctgccgtctagtaaggtcatcgggtgttgaagtagtagtttagtgttagtgctggccgttgtacttacggtgaggtctttcatctacgtaatcctctttatcaaagttcgccagaagtggaagtacccaggaactagggttttcccaagaaaagaagaaacggtgtgacattcaatggttggtaattttttcgaggttttctagtttgtgtacagtaatacgaacagatgtccgttaaataaaatcgtgtgagctacacgatttacataaaagtagagttgtccagttcatacccttgttacaacgactatatggagtgagaaagttaacccttcgagttacgttaactattaagggaactaac

SEQ ID NO: 483 - DNA, 1887 bp, Populus balsamifera subsp. trichocarpa
  misc_feature (1)..(1887): Ceres ANNOT ID no. 1464944
  misc_feature: Encodes the peptide sequence at SEQ ID No. 174
tggcaatatcttcactctcattgagttgggcttccactaccttatcccaaaaggtcagtgtcaattttctcctcacattactgttcatcttcctctcgcgtgtttgttatgaaagctaattcttgtattttcattctctccatttttccagttaagtgtccctggttcaaatgaaatattgcctagagtagcagcattttctggcaataactctgtaacatgcacggcagaggcaaccttcaatgaagaaagtaagatacctttttaagtattctcttcaaattcactgcctgtaccatggtagagtgtgtagagtcagacaccgtctcaacacgggaatcgtgtttgttgtccactggaatccacatcatcactcatgaatttgacttcacctcccagtattaggatattttgcatgaacaatgcgaatcatctacgagttatcttcctaatatatgagcactgtcatggggttttcgaataattattgaataaacttttgtcttatattgccattttattgtaatctatataaccaactcatctcccttatgttgctcgatgctatccatgtgatataggcaattgcaagagacgtctgctactgctaggagttggagcactaacgacaagtttagtcccagcaaatttcctttttgctgaaggtaattatagactggtagttatctctatctattagcggctagtgtgcaaatgacttgttgaagctttctcaactgtggcactgtgtagagataccaaagaactacacatcttttgtggactttgaagatgggtattcatattattacccctcagactggattgtaagttatgcaatcatatgatactgtgtaaatttgaagttcagctctccaagactcaacaacctgtcttgtccatttcttaggattttgacttcaggggacatgattctgcatttaaggacagaacgaagcaattgcagaatgttagggtgagatttataccaaccgagaaaaaagacattcatgaattgggtccaatggaagaggtagaaagattttaatttcattcccttttcatgtcattaaagcctaagcacggtacttgacatgcttttcttatgtcaggctatatactttttggtgaagcacaggtatgcagcaccaaatcaaatgccaaccatatacagcatgcaggaggttgtatcctgtctatccttccagtttattgatttctattagctaaaaatacttccttccttccaaatctggctaagattagaccctcttaatgcttgctgatttcctacttcctgcgcaaaagattttaacttgctctttgctcagaaaatcaatgatctgtcattcttctgtgaagtatgacagtcacatgcagcaagaaattatgaacgtgaaactttcaaattttcttgaaaaccaggtgtataacttcttgtgaattagcttgtgatgatggattttagtttgagaaaagttccagcttttggtcagtgaagacattctttactggcacactgaatctctttgatggctttattctgaatgcagaaaaccgtagagggaaaaaactactacaccttcgagtacgaacttacatctccaaactactcaagtgtttcatttgcaaccatagttattgccaatggtaagtatcgtatcacttgaattgttaccatgtgccgacagaagtgaaggaaaacgtgtaagaagtgggaaaaagatatagatgaaagtgcttttcagaatctggattgttcaatggttgtatctctgtacagggagattttacactctgatagttggcgcaaatgaaagacggtggagaagatatcgcagtcagctaaaagtggtagcagactctttcaaggtgcttgacatctaa

SEQ ID NO: 484 - DNA, 5190 bp, Populus balsamifera subsp. trichocarpa
  misc_feature (1)..(5190): Ceres ANNOT ID no. 1514021
  misc_feature: Encodes the peptide sequence at SEQ ID No. 181
tacccctcaaaccctcgctataattttgtgggtcgactaaatatgggtgataacttcgacttttaccgacgatttgtacgacgttttgtctagggcagacttggagtgacccgaaagacaataaggtacgaagtagcccagagagcatcaaaacgaaagcaataagttgtcgaaccgtgtcttgaggcattgcgacattaatataaaatgtaacgtgaaaaataacaaaatgaacgcaacaaaactagacccaaaacacatcattcataaattattagtaaaaaaaaaaaaccaaacgtccacacgtaaaaaatgaaccaagaagctcgggaactgtgacaaccaaacaagaacaattggaacacgaaacagacactaaaaacaaaaataaagaccgtcttaaactatgtaggatttacccaaaacaactcaaaattctaattactacatcacaaaatacgatccgttaacaaaccaaacgatcaagaagttaatacaaaactacctaaaatcttagccgctcacagtataactcaaacttcaacgatcgagatcgcaaaaaatataagattatttaccgatcacctctaaaatcaaatctactatcaaaacattggcttcaggactccagtaaaaaaacttcttttttttttaactctcctctctcgacaaccaaaacgaatcaattccggacgacactcctcttcaaaggaacttcgtgagacaaacttattgtgaactaaaggtgaattggcaacatgaataactacgataaaacaatcaactatgtaacaaaaaacaatttacaaaagctactaaggaaatgtctcctactatgttcgtatggatgtctacagtttcatggataagactatcgaaaagtggcggtgtaaatactagcgttaaccgtaaagagtacactcagaactttaaaatcaaaactataggaactaagatgttaaacctcttgtcaactgaacttatttaaacaacgactctaaatcgaactattaaagtaggcaggtttgaattgtaaagaagagacacgtttattaaagaacatgactgatttatcccgtagatctgatatggttaaattcaatcctaatcgaggacaagaaaacaagttagtgttatgtctacaattgttataaacaaatattgttgatataagtcaactgtattcccacgaaacattacggacgtttagcaaacgtaaataccagacgatattttaatgcacaagactataatggtaaaaatcaaactactgagttcacagatcaggttctctaacttgtaaaaatattttaaacaaaatgtaaatagagaatgtttgtcaactaattacagactctttcagagaggagaaattccatcggtctcttcaaatgagcactctccgttgtcaaggtaccgtggacatagacattttacattacagttaacttataaaaacgagtgagattaaactaagaagaaaacgtattccaccatggttactgatgtcccaagaatacctggtcaaggtactacaaagttgacgaaaagatctcgaactttttcccaatcaagatggagtaaaactgaggacaaactaacgtacgactaactcctagactaactaagtcccagatatattacacgagatgtgaagattgttaagtaacgtaggttagtgttatcacagacacgcggacaaagaagaagttatcttctgaatactttgaattaaataagacgtcaatggtcctccgttaactcctataatggttttcttacccacgtccctaccgtttcaaatagacgttcctccaatcaatacaccccacaacattacgccgtagcttaccacgtacctattgattgaattccttttttcctaaagagatccaaggtgacgacttaacgcactatgtactatgtttacacccacagagacactaacgtaggtagtactatagttttcatattatttatacgtgtacatatgacacctgacatcactcgagttcgatatacgtagtgtccttagtccacgaaccaatagttcatcgggtacgttaaaaataaacccagcacatatctactacttatctaatagttctcttacttcttacttatcactttagatctcataaatcagtaggaggatctctatcgtttcctgtgatccctaccgacacactagggaaacctacagtcgatttctttaagaaacttgagttattttatacgactgtcttgataagataggatgtcccgaaattgtcaaaggagtaatgagtacaattagtagtttaacgtgttcgaagctaaagaagtcaaaaagaattttgtcttaccttttccaatacaaatacactacggtaatctgaaagagcagacgtccacctttggtaactactgatactacttataacggtgatacatcgtcctgaacaacctgacccgaacaggttcgaaaaggtacggagacttaatcttctaaaccgaagtctatcgtagaggttaagttaccctaacaaagaagtccatagtgatactacgttctcggtaactacacgaaatagacgcccaactgaaacaaaactttacattaagattgtacatataggacctaaactattttgaatcttttgtttgtaataagcactaatagacctcctgtatttactctatggatacagtgcgtacaaaaccggagcgctctaaacctcatttatacagttgtttgaactccaaacgaagaaaaggtaaatagcagagttgaaatcatggtatttgtagggaaacatcagtaatacaagcacttactacatttatattcatgttatgaactttacactatcaaaataaaaaacgaagtgggtagactaattgtaagagggacaaaacacaaaacacggagtcctgaactttatacttctcttgagccagctccgtcatgtcacgaacttactgtaccaatggttaaggaactatgtacacctactaacgaactttatgtacagacgtaacgcccttggacgatataaagccaaaacacgatagggagtccattctttatacgaatttgactggaaacttctatagtaacaaagtacagaacattaaactggtgaactgagcaagaatacggaaaagtgaataagacgttaaaaaattttttcaaaaagtagtacagtatataaaataatgtgccacttctttcgagtgttataaaaatcagattaacacatcaaaatacaaatcacaaccgatattacctacaagaccaccttcgaaagaagattaaactggggagaggaggatccagtaccgatagccttgggatcgttacacgatgttgttgtagttacagaagtctccacatcacttctactctgctccattctaatcaaatatctgacgtaataaaagaaccgtagactttgaccaccttacaatatcgttattgtctttaacaaaaccacgtacatttatagggtacttctgaccttccaaaactagcaacaatacaatagtatttacatcttaacgtagatcttacgtttacgttatattctatagtagagagaaatcttatgttattccaataatggtctacctggtaaggtgtttatggtaaacaaacaaacccttgacgtattgagagtctgattcatttagtacggggtcgaacgtatagagtctaataaaaatttttaaagtgtggggtagatggtatagtggagacaggggacgacgagaaataacatgtttcctaagaccgaacaattaattcatggacgtagttttattattccggacccaaaagtactaaggaataagttactacaaattaaattacgattcggataaagatccagagtggcgagtttaaaaagtagcttgcttttgttaccggctacagatacctcgaaagaaactgaagagaacatacgacttcaggttccatactacgaaaggaattaagattggttctgtaacgaaaaggaccgtccaagttcatactttcaatataaagagggcgaacattttttgtggcttgggatattacgaagtcaaaaagaacggtcgaacaaaacacgagcaagtagagtaacttggattcatctagctccggtcaatctgaaagatcttttattaaagtatcttccctgaaccaccttagaagggattattattacttatataaacgaacatagttaggggagtcccaactacttactcccctactcgtttactatcatccaacggtgtaacaaacgacacaccatcatcggaaactctatcacataattaattgatacaccgtagaattattgttgttagttgttgacaccaccaaaacagtctaagccttttaccttcaaatacatatttccaccctcgaaaaagtgatcctacggtgacttataaatacctcagctaatactaggagttcaaacaaacgatttaaaagatccacggatataactctttacacgttaacctatgacgtccaactgtccttgctaggattacgttgtttttgtaactcgtcagaccttcgtcatgttttttgaacgtcccttaggccccgaaatttgttttccaaacggttcgataggagactcggaacttaacaaaaaaacaataaaataacccgactgtaagaaagtacgaagatggtcctttagaatgtatgaatccttactcgattttatattaagacaagaccactcaagacgacttaacagttggcctaaaggagcacatcggaccaactttgaaacaacaagttttgttaaataaataaagataaaaaaaaggacgggaaaagttaggatgactaattagatgtcaacttactgatatacgtagagcatacgaaacacccaactaggttcttatagtttacgcttatagtagactaaagaaaatagcagattacgtctagcaggaggagaagtaatataacagataataaaaacgaatagagagacggttggctagttcaatgatcccattcaacacggtcctttttttaataactaacctaaacgatagtactattactaaaagattttttgaagcaaacaactacgtgtcctaccagctaaagaacttaaggggtcacacgcatacctactaccgaccgatgtgttcacggacaagataaggtaccttcgacgaaaagaatat

SEQ ID NO: 485 - DNA, 5159 bp, Populus balsamifera subsp. trichocarpa
  misc_feature (1)..(5159): Ceres ANNOT ID no. 1503464
  misc_feature: Encodes the peptide sequence at SEQ ID No. 184
tggggagtttaggagcaattttgaaacacccagttgacatatacccattgctgaagctgaaaatggcagctaagcatgctgaaaaacagatcccacgtgaacctcactgggctttctgttattctatgctccctagagtctctcgtagctttgctctcgttatccaacaacttgacacagaactccgtaacgctgtaagcataatttccattgcattttcatgtgttatttgccttgttttgatctctctctctctttatctgcgttttgggttgtgattatttgttgattatggattttttcatctttgcaggtatgcgtattttatttggttcttcgagcccttgacactgttggtttgttcttgttaaccttatgttttgtatgtggtttttggttttgtgcctcgcaaaatttgataaatcctcaacgggttttgttgaattttaagattgattatgttttgtttttgtgttagacaaatgttgatgcactaggtcctgaaatggggtttgctgaattttaaaatccgcgagtgtcatattgagtttgaatttgctagctctaaaattgtttatgttctaatatatggctagtgggaatttttatgatagattttagttttgcaaccagaagtcacgaggtcgttttgtggaagaaaaagaaatctgagatgagagtggtagcttttgccttttgctaagtagttttggcctacagtgaggagaagattctttaaaacaccctgtctcagtaacactttatctcctcttaactgtttcacttattgatgtcattttgttagttgatacattgtttgtgttttaatctgttctgatcattcctttacagaggatgatacaagcatacctacagatgtcaaagtgcctatcctgatagcttttcaccgccacatatatgatcatgactggcatttctcatgtgagttctgaatttttacttttattttccttgattctaacaaattggagaacatttgatttgactaaatttgttttggctttgataatttccatctgcttaacatttcttctctgtgcaagtaatttcttccactgacaaattagggcatctagactataccaatctaatttatgattaccctaattcttttgttctatcactgtacagattttaacactatttgcttataactatattcagtttgcataagggtgctttgaaatgcctgaaaaatcttatgcatttatgacctgctataaaattacgtgttctgattttaccatttttaatttgataaccatgtatctagtccaagcttgaacattcttataaaatttgtttttacatctatcttttacaaactgttgattcatgtccgagtctttcctttttgatgaagtttcagaagtttatacatgagaggtgacaattctatggcacttatatctgtaaaatgtaacatcaactgaatattttgactctctaatttgattcttcttttgcataaggtggtaccaaggagtacaaggttctcatggaccagtttcataatgtttcaaatgcttttctggagcttggaaaagggtcagttctacaaccttttgcctcctgcttgactgtggaatgattgaggatttaattgttttagggtctatgtattctgctctacacatctatcaactcattgcatctgatcactatagtgtttgtgtgtgtgtttcttctccaatagaagacttatggaactcaatttattctgcagttatcaggaggcaatcgaggatattaccaaaagaatgggtgcaggaatggcaaagtttatcttgaaggaggttggtgatgtggggtgttgtaatgcaggattgaaggatggtgcatggataattaacttaagaaaaaaggatttctcttggttccactgctgaatttgcatgatacatgatacagatgtgtgtgtgtgtgtgtggtgtctgtctctgtgaatgcatctgtcatgctatcaaaagtataataaatatgcagatgtgtattgtggactgtagtgagctcaaactatatgcattccaggattcagttgcttggttatcaagtagaagaatagattatcaagagagggaagaatgaatggtgaaaagttagagtatttagttatccttctagagagagcacaggacactagggatgcatatctgatccctttggatgtcagctaaagaaattcttgaatttaatataaggctataacagtttcctcattttttatgttagtcatcaaattgcacaagcttcaatttctccagtttttcttaatacagaaggtgaaatgttatgtttatgtgacacattagactctggtatgcaggtggaaagcattgatgactatgatgaatattgccactatgtagcaggacttgttggactgggcctgtccaaactcttccatgcatctggattagaagatttggcaccagatagcatctccaattcaatgggtttgtttcttcaggtaatactattatgcaagagcgatcaatgtgtttaatctgtaggcttaactttgttttgagatgtaattctaacatgttcaatcctggatttgataaaacacagaaaacaaacattattcgtgattatttggaggacataaacgagatacctaagtcacgcatgttttggcctcgcgagatttggagcaaatatgtcaacaaacttgaggtctacttcttttccatttattgtctcaaccttggtaccatcgacatacttttgccatctttatgttcatgaatgatgttaatttaatcataatacttgaaagtaatatttttttttatttggtccatccatctgattagcattctccccattttgtgttctgtgcctcaggacttgaaatatgaagagaactcggtgaaggcagtgcagtgcttgaatgatatggttaccaatgccttgatacatatggatgattgcttgaagtacttgtctgaattgcgggatcctgctatatttcggttttgtgctattcctcaggtaagaaataaactttaaactgacatctgaagatatcattgtttcttgtcttgtagcttgactacttgaattatacttatgccttttcacataacctgcaactcctctgaatttttcatcctgtcaaatattttattactcggtgaacaaatccctgtttagtaataggtatgctggatgttttggtggaaggtttcctttaatttgatttctctcttgccagatcatggcgattggaactctagcactgtgctacaacaatgtcaatgtcttcagaggtgtagtgaagatgaggcgaggtatggctaatttatagacagcattctttccctggcacctgaaactggtggaatgttatagctgtaacacagattattttggttcatgtaaatatcttatgaagctggaaggtttttattattgttatgttatcataacatggaattgcatttagaatgcaaatgcaatagatgatataatctcccaaaatggccattccacaaataccatttgtttgttcaggaactgcataattctcagactaagtaaatcatgacccgacttgtatatctcggattattttttaaaatcccatgcctcatccaccagctcacccctgctgctcttgagtgtttaaaggattttagtttgttgtttattaccaacatcaaaatataatggactgggttttcatgattccttattcaatgatgtttaatttaatgttaaacgatttctaggtcttaccgctcaagttattcatcaaacgaaaacaatggatgatgtctatggtgctttcttcgacttctcttgtatgctgaagttcaaggtatgatgctttccttaaattctaatcgatatatcgtttttcctggcaagttccaacatggaagttatatttctcccacttgtaactaatactgcgccccctttaatgcttcagtcttctcttgctagcttgttttggacttattcatcatcttgaacctaagaagtatgactgcacaatctttgccaaaaagactttctagacaataatttcagagaagggagcaacacttttcatgcttccaatccttgacaataggaagcctattgtgcatttcaatttggtagaatcttataagaacgaatttatgttcttccatcaaaaccttatgcggttaggactgcaccactcccctctttgatggataagcaaatgatattaggttgctacattgtttcccctgcttggttgtaggctttgagacattgtataattcactaatgtcacatcttgataacaacaatcgacaactgcggtggtcttgtcagattccgaaaatggaagtcttatgtataaaactgtgagctttttcgccaagtgcctgtttggtgtggtcgatatttatgcacaccaagtttctctaccttcaagtttgcttgctgaattctcaaaaaaaaaaaaaaaaaaaaactcgtgcctatattgagaaaatgtgaaattggctactgcaggttgacaacagtgatcctaatgcaataaaaaccttgagcaggctggaagcagcacaaaaatcttgcagggaatctggggctctaaacaaaaggtttgtcaacctatccattgagcattgaatggtatttttcttttctttctttttttggctgacactctttctttcttctaccaggaaatcttacataattaggaatgagccaaaatataattctgttctggtgagtttctgctgaattgtcaacctgatttcctctcgtgcatgcatagttgcaagtttcttgttccaagcaatacatttatttctaattacatgctatgcatataaatttcagcatagactagagcttgctggattgtatatttttttaatcctaatttttctgtgaaatatgcactttatttgatatgaattagatagaaaaagaatgaatgagattaactttcccccctcctttccaatcgtgctgattaatcgacagttggatgcctataccagtcttgtatgctttgcgggttccaagaatatcaattgggaatatcatctgatttcttttatcatctaatgcagatcgtcctacttttcattatattgtctattattttcgcgtatctctctgccaacagatcgagttactag

SEQ ID NO: 486 - DNA, 4480 bp, Populus balsamifera subsp. trichocarpa
  misc_feature (1)..(4480): Ceres ANNOT ID no. 1483290
  misc_feature: Encodes the peptide sequence at SEQ ID No. 198
tactccatttaatgagaaatttttttgtaaactctaaagaaaatttcatttagctttccatctctatttttttttaattacatcttttttttacgattaagaataattatcctttgaacttataactaaagaacgttagaaccaccatgtaaacgttccatagaaatcaacctactgattaaattttataagtagtataattctccgggttgtacgttatttttatttttttgtttttgtttttccattctaatataagccgccgatgaaagccgcttcttatctcccgtccattgcatattccttgcgcttcatgttatcatcgtaccctggtaggggtagggtaggcgccaaacccacaaagtttatcaaaaaaggacttaaaatttaaaaaataaaattcaataaaaaatttataaaattatccaattataattttttcataaaaaattttttattatttttataataaaattatataaaagattatttttataaaaaattttattaataatgacgtgaaaaaatgtgtcatgttagtgttacatgtgcgtggaataaataattaattataattcttattttttttcctgccaggtgtttaattatatttcaggagatgggacgtcttaggaatttaaagtaagaaagtaaaagaagagagatagagataaaaaggagacttgttggtttagagtatttaataaaatttttttgggcaataaaaggtcttcctcctagttaggccacgcggagataagttaaaaaaaaattagaataccaatactaccaccaaatctctcctagctagaactcaattctctaaagtaaagaacaactactactaccactacttaaaacacaaaaaaaaaaaaatccaagaacgttcacttcttcttcttcttctctaccgtagctttgcctagaacttccttaactttctaaacgttttcctgggaggatgaagtacgtcgcggccataaagttgaaaaaagcgtagatatataaaaagaaataaaacaaaaaaaatcgcaaaaccaactagactagagaagcaacgcacaatcgaaaaacatatatataaaaaaagaccttaaatactgctactactatacgcacgttaacttattatgaccgctactaattaagactggctattcgaattcataaattccgattttaggctacgaaaattccctttcggtttttattacaactttaaaaccaactaaaaattattaataccaacttttggcgtcccattttgtacttctatgtataataaacaaactaaacgaaaaagttccacatgctcatactccttaatcttcgattaaaagtaactaataaaagtaaaatacgaaaaaacaactaaacaaacgaaattaatacccttacaacttccaggacaacgacttctgtacaaggtaaccgttcgttgttaatacccaggaggtctatcgggaatacgaccaccacaaaaggatcaatgataagtaaaaggaggtctgataggtaaattcggagggttccattcaaaaacgaacgatgcacgttccgtattacaaaaagcagacttcttcaagaaatgaacagatatcttatttcaagtacgtgtaaattttatatgaactttaacgactgcaaacatttgaacttaatgaaagcaacagggagacgaaaaaggaattaaggatcacagggtgttagtacgaacttcgaagtaaccgtggctaaagggggagatggaacgttctacagagtccaaggtcggagggaaaacatattcttttccacagtacgtcagtaccttatcgatagaggaacaaaggtgggagtggagaaaagaaaaggggaatagagaatgagttaaacgttgttttaacttcttcttcctaatcataacttaaataagagtagtcttcgactaagtaaaactgtgcttccgtagagcacacacttataaacgttatccagtttgaaaagaattaaaaagaatttagtcgtcgtctttgtctcccccgatctacttgatattcgtacctttggactaaagtgtcgtattcgtgctcggtcaaattatcctgggttgatttctgtgctatgttaagatacggaccaggagtattttactctattctacacttcaaatacaatttactatgtcgagaacgtagtttccgaacacatagtttaaagttgaaaataacactaaagtcttttgtccaaaacaaaaaattagcgagtacttccttaagatcgtaattactcccttatagtgggttcgatttcagtcgatttatactttatttactataatgtatttttccaacttctatatttgacgggactaacttaccaacacggagacgattgggaggaatgtacgtgttatactttagattgaaattcaatgaagacaaacaaaccactgaattggaaacctcaaatatacagtaaggtaaacaaccataaacgactcatcaaaatcgaaggaagaaaaacacttgcggagtaacataagaaccaaagacaaatacgtagagtaacatacgattgatactgaagacgcatacgttaactcttcagttagaataggtcaagagatatacatacactaaaacaatttacatacgtagaaaatccatcgtaagtcttgtttccataaggtgggtttatatttatcgttaccttcgtaaacggacctgtaaaacttcctcgttacctcgggacgagattggtataggttccaagcttaagatattgggaatttcgtagaacctgaactcttctttcacagtaaataataaatctcgtacaaacaaatacgcaagtttttcacgaaaacttttaaaaactaaaaaaaaccgaaatttaatatataaaaaattactaaaacctagcaaaactacacaactacaatttttatttaaaattttttattttttaataaaattacgtaaaggttcttttttaatgaaattttttgttgacgatgatgttagggtttgtgatagaattacctaaacacaatcaggttgtagtaaaaacacgttctttccctgttaacaaagaatggttggtaactacgtaattacataatttttttaggtagtgttatttatctctattctccttacgatcgtgctgtaagagaaaaacccacaaataaaactataattaaaaattattctcttcagataggataaccaacatacccaagtacattaaatcagaaaaaataatacgtcttgagatttacaacaccctttttgtaacacgtatgtttgtgttaagtacgagagtgtaaaatgaaatctgagtaacacgttttaaaaaggaaaagaaaattaaaactaggaatttaaaaaaaaaaaaaacgtactaacatataaaaaacccagtttaatttcctgttaacttaatttaaacaactgattcttattttaacttttttctacggtttcatcttttctgttgtgtttactaattactaaagtttcaagagttttttcaaattaaatcaggagtttgaaaagtttaatatggacaagccaggtagttataaaaacgttaagttaaaaccatactttcgaacaaaaataataaaaaatcaagaattaaactctctctctctctctctctctctaagatcgccgtctctatcttttagttacaactgtggttaaatcagtagttttattttttaaaactactgatttaaaataacaaaaatagtaacaaaaacaaaatatgtctatttaaaataaaaatttttatttttttaaaataaaaatctattataaagattatacacgtaataacatattataaaaaaataagttaattaaaatatgcatatacaaaaataataataaactaaattatttttttattaaattgtttgtttaaataatttgtgtaggcctatttatcaaacacaatattctaatttatagaactaaacatagacaaaaaactaaacaagttaaaataaaaattaatagcaaatacttaaacaaaagtaaataattgaatttaccaagaactatataaatgaacctatatacgtatccgaaaagtcaaatataaatcctaaagaacacattttaacgtacagattttcagacgggtaagtttaaaaaaataacctttttttatagactaaacgtcacctcacgacaagtttattgaactcagtttattgatcaacgttagattagaaacaaatctcgggggagagagacaaaaaaaaaagaaaaaaaaaagagaaaactgaaaacttaacgatctagaatgaccactactacgttccgcacaacacaaaggtacacatccacaacgagagttagacaagagacaactgcctaggattggggctactaggtgaccacggcctctatcgagtgtacatgttctggctgtccttgttcatactctgttgacgttcttcgacctgggtcttcatacgttacccgat

SEQ ID NO: 487 - DNA, 2726 bp, Populus balsamifera subsp. trichocarpa
  misc_feature (1)..(2726): Ceres ANNOT ID no. 1467392
  misc_feature: Encodes the peptide sequence at SEQ ID No. 219
tggcatcgaaacggatcttgaaggaattgaaagatttacagaaggatcctcctacttcatgcagtgccggtattatgactttttttgtttttaatttttttccgatttgtttgacttcatttcttaatagtttttttagtgtttcggttgatctgtgccggtattatctttttcgtttttttggttggaattgataatgatttcgttgataatctaaggatgcatgcagttgaataatactggcgatgattaactctgatcgataattttctttgtaaaaattaaaattcgatttttttaagggaaagcgtaaaacaatattgaattttttttgttaatttttaaaaattatagttaaaaaacttgtatattctgatcacagggtgtattattttagggtattttttttaagcaattattgttatcctggctattcttaataatggtagggggtatgtatgctgaattaaaagttatttttttcatgattattttatttaatgttgtttacttgatgtgcttgctttaattatgggaatgttgcaggtcccgttgctgaagacatgttccattggcaagcaacaattatgggtcctccggatagtccttatgctggcggtgttttcctagttaccattcattttcctccagattatccatttaagcctcccaaggtaagtttttactccatacaagcttaacttttgttgttctgaattatttgaaagttttgtcgaatgctaataatatgcaggtttgggtgaagtaagaagtatcaaacagattttttaaaaattctatgtatatgtatttctcttgaatgctttgtatgtgtatatcattacctatattgtctgcttaagtattgcgagttgcaagctgattttgcagattttcccaggtcatatgacttttgctaacccagagtatgtacatacactagttaacctaagggaggaatctttatgtatatgccctgatgagggaataagttctttacttgacaacagaataaagtggatgcatatttaatatacatgaaactaatggcgcttgcaaacttgcatttttcatacccttttcttaattcttattgtcaaagaatcatgcttgtagttccactgtcaccaaggcctccttctggcagaggccttaggtttgagcctctcttttgtaacaaggaaaaaggtgtcatgatgtcatggagcatctccatgtttcctcccattcttttttcccctcacctcttgcccaattcacaacaagaatgaagggagattagtatggatgttgaatttattctcatcagaagttgatttatttcaacatgaaggcgtctcatctgtgaatatgtgcaataggtcgagcttttattagtcttatgctgtttccaaatcagcagaattggaagaaatatagggggctatatgaagtataaagtataagcatgcaaacctgatttcacaatacaagcatgaggctgtttgataggattcaatgctatgccaggtcctgatacaatatgagctaagatgtgaagatatgttaaatgatgcagctcttgcatctaaggcttgtgtatcaaacatcaacttttggtaaggattttagaataagaatatgctttatttcttaattgcacaagaagaaattatagcattaatgagggtatgttgctaaagctcaaatcagctaaagatgaaataaatggtattgcatgaaaggctgaagatataaactgccctgattgaatggttccgcctctgcttgccctcttgccatgcacaatataagaatttattagtcaatttgtttgtttggtgaattaaccacggtaatttatgacattcaattcattggtatttgccgagtagttttagctgttttctttttgtgaatgcctcattgtattcttggtgtgttgcttctgcatctcatcatgtactatttatggcactcctgcacattcggtcgagaattcaatctcaaaagcagttctctttttgtgcgtgtgatttcattatgtgtatgtatcttgcaggtagcattccgaacaaaggtattccacccaaatataaatagcaatggcagcatttgcctggacattttgaaggagcaatggagcccggctctaaccatatccaaggttcttattctataatcatcaaatcatttatgttggagttgagaaaaaaaatgctgttgattacttaaatggatttgtgatagtccggcatctttttgtgttgggaagggactaagtggttcattttcttataaccgttcttgatgtgttgatgaaccgaatagttcattgcaacatatagagctaatttagatctcagcagccctccttttctttcccctgatttctgagagttcacctttctgcagaaaagatatttaggactctaaaactgtgttattagttgataacatattgtttattcatcagccatctgcagctcttttttctcccttttaaatgggctatttttaattcgctgtcatagcgcaggctgacttttgaattgctagttatcattgatgatcaagtaaacaagttctttttccatttgtaggtattgctctccatctgctctttgttgacggaccctaaccccgacgatccattggtgcccgagattgctcatatgtacaagaccgacaggaacaagtatgagacgactgcaagaagctggacccagaagtatgctatgggctaa

SEQ ID NO: 488 - DNA, 1437 bp, Populus balsamifera subsp. trichocarpa
  misc_feature (1)..(1437): Ceres ANNOT ID no. 1529647
  misc_feature: Encodes the peptide sequence at SEQ ID No. 222
taccgacgtttcgcatagaacttccttgagttcctaaatgtcttcctaggtggatgaagaacgtcacgtccacacgttataaaaaaatttttttaaagactttcgggtcgagaaataaataagactaaaccgttttaaagtcaaaagacgaagggggggggggggaaaatacacttgaagtcagacgaaccaacaccgaacttcgggtgagacgaactcgaaaaaaaacgttacctactaatcaaaatagaccctaacaagtttagacctccaaccatttaggacccaaaactaacctatatatccaggacatcgacttctatacaaagtgaccgttcgttgttattaccctggacgactatcaggtatacgtccaccccacaaagatcattggtaggtaaagggaggactaatgggaaagttcggaggtttccattaaacaaaacgacagttacctcgttaaggtctaaaactgaacacatacaccaatctatttttccaaaacaaaacaaaccaacacacacacgcgcggggaaaaaaaaaagggcctccctattactacaaaaaaaaaatgtgagaaaagtccaacgtaaatcctggttccagaaagtagggttgtaattatcattaccttcgtaaacagaactataggagtttctcgtcacctcaggacgagaatggtaaagattccaaactaaaacgagacaattatatacgactattgtacaattacacgacgtcaagagcaaataatgatcgttatgtccgtaagtgtagtgagagaaggtttaaataacaatgatcaatacgaataacgattctcacagtagaatatctaaaaataggtacaaataacagacgttttacacaggtagttcttagatcttacaataagactttactggttcacattacaatgccgtcattttaaacgaacggtcagatactaacaaacacatctatcgttaccacgcacagaacaagaggacaaatcgttgaacttacaagaggacgtcaattacaaagaatcctatattttgtactcaaccgacgtacaaggtatctaattcttgtactccgagagacaacgactttaagtttgtcccgagaagaagaagaagaaattaaatagttacgacagtttcgtcttaccaagtcacccaaccaacccactcgtactccgaaatctaaagtagaactttgattgtgtcttcagagacatgaaatgagggtaccatggtgtcagtttctttctaaacaattaataatgacgattaactacctacggatagtccatgacgagaggtaaacgagtaacgactgactaggtttaggactactgggagaacatggtctctaacgggtatacatgttctgactggctcggtttatacttcggtgacgagcgtcaacctgtgtcttcatacggtacccgac

SEQ ID NO: 489 - DNA, 1061 bp, Populus balsamifera subsp. trichocarpa
  misc_feature (1)..(1061): Ceres ANNOT ID no. 1450556
  misc_feature: Encodes the peptide sequence at SEQ ID No. 231
tggcatcgaaaagaatattgaaggagctcaaggacttgcagagagatcccccaacttcatgcagtgcaggtaacaggagcagaaggcttgaatataataacatcacggttcattcttgtttagaaagttacttgactgccttttgcctatttttatttcaggtcctgtggctgaggatatgttccattggcaagccaccatcataggtccaaatgacagtccctatgccggtggtgttttccttgttaccattcatttcccaccggattatccttttaaacctcccaaggtaagataaaaagaaaaacaagactgttaagccctttctcatgattagtgttgtctttctgtctataccatccgaacatgtctataccatccgaacatgtctatatgatgatcttcattgaataattgcaagcaggttgccttcaggaccaaggtattccatccaaacataaacagtaacgggaacatctgcttggacatactcaaggaacaatggagccctgcgctcaccatatcaaaggtggggttatcatgaagaactttcttgaacaggacaccacataaatcttaaaatcattccactctaattgcacataataattaaggcatcaggactgcgtcatttcaaaaaatcaacaaatgattctcaaaatctcaaattgcgttgcgtctcttcttttctgatacatcatggagaacagtactcgtgcagataggaactagcctatttaggtgctccctccatttgagtcaggccaattaccttgaattataaattacaataacccttctataaagaaagagatggacgcatgcctcatctcacattcttttaatcctttccacgctcaaggcttcaagcattgcttagaattattctgacatcttattgtgggggattcatgcaggttttactctccatatgctcactgcttacagatccaaaccctgatgatcctcttgttcctgaaatagcccatatgtgcaaggccgacaagatcaagtatgagtcttctgctaggagctggactcaaaagtatgccatgggatag

SEQ ID NO: 490 - DNA, 1777 bp, Populus balsamifera subsp. trichocarpa
  misc_feature (1)..(1777): Ceres ANNOT ID no. 1533930
  misc_feature: Encodes the peptide sequence at SEQ ID No. 240
taccgaaggttctcctaattgttcctcaactttctggacgtcttcctgggaggacgaagtacgtcacgaccaagcgaagaaatgaatgggaactaacaacttagtcaaaattagaatatttaaacaaagaaaccaaattattaatactatagttgtacgcaagaatcaattgagccctaccctaacataacttatatccatggggtcatttaaaagcaacacaaacgaaatttaacgtgctcgtgtaactagactatcaacaatctacaccaactcatcgttcctgctccctaaccaaattttctcattagttactcttagattaatgtaaacgatactttatgtctgacaaacaacctatctcaccccaagtcgatagacattcacaccacagacacacaactagtgaacgccctcacttgatttttcaaaagtagtaaccttaacaaaacaccactcaactaaccctaaactataaagttacaccacaacacctgtaccgacacatctaactactagcgactagaaaaagtaagtactcggaactggacagacgtttgattatatttcgactacttaagccggttttatataaaacaaaagtgatctcaaataactaaacttagtaccgaacactgtatgatacgtacgcatgtccaggacaacgactactatacaaggtgaccgttcgttgttaatacccgggtcgactgtcgggtaaatgaccaccacataaggaacacaggtaagtgaaaggaggtctaatgggtaagttcggtgggttccaatagttaaacgagtagaaaagactatggtaaacggaacgtaaggaagagtaggagggtgggggatatttcgccacctggacatttaccaagttcctaccggaacacagtcaggaccggagagagagattaacgtaacgaaccaactaaaccccacggtcagacatcctggactttacgtgtaggacctcgaagcatccgaaagtaccttcgcgaaaaatagtaggggcatcgaaaccaacgaacggtgtatccaatactgtgtgattaggaattctctcgaaaaagagaggctctttttcttccgtcaacaatcgcatcactaagttagaaagagcacccgaaaactacacaaccctaaactttgaaactgagagagacgaaaagaccaacatagaaaaaaaagggaagttaaaccacccgtaaactacacaatactaaattttcaagagaaagacctacatttataaaaagaaaaaagactaaactaatacaagacctatccagaggaaggcatgtttccaaaaggtgggattgtagttgtcgttaccttcgtaaacagaactgtaagagtttctcgtcacctcgggacgggaatgttataggttccatgatactaaaaagaaggaagtacaaaataaagagagagaatacatgtaccctacaacacaatcaggtagaggaggaactggtctcaacacaaaccgtaccgagacaatattctacgctcacgaatataacattacgttatcactgagatctagactaatatcaaaacataaacatcatattactgtaacctaagcatataagaaaaaccttatttatttcttatgtagagagaacatccaagaagacagatagacgagtgacgactgactaggtttgggcctactaggggaccacggactttaacgagtgtacatgttctgtctgtctcggtccatactttgatgacgtgccaggacctgggtctttatacggtacccgat

SEQ ID NO: 491 - DNA, 1297 bp, Populus balsamifera subsp. trichocarpa
  misc_feature (1)..(1297): Ceres ANNOT ID no. 1495171
  misc_feature: Encodes the peptide sequence at SEQ ID No. 242
tggcttgtgacatacaacgcatgcttacaggtcctgttgctgatgatatgttccactggcaagcaacaattatgggcccagctgacagcccatttgctggtggggtgtttctcgtatccattcacttcccaccagattacccattcaagccacccaaggtaatcactatgctcatttttctgatactccatgccttgcattccttctcacccccccccccccccccactctttctcccttcctgaacatgcttcattgcgcttgtgcgcttcattgcgcttgtgcacttcattgtgcttgtgaattatctgcattatcgtatctgttttatttgtgaattttcatatctgttttatttatactgtatacatagtccattgagcgcctgtcctctttccataattgcaatgttttcttttgttaaaaaaatgggtgttcctgacactgtgatatccctttgcctcgtttttgcttgaaacaatttgcaattgagtggtgaacattccaatgattgaggatggctttgtgtcagtcctggcttctcactttttttttttctctcttttttaattgacttgcttgattgccagagcgtgccagtctgtcggaccagaaatgcacatcctggagtgtcctatggcattcatggaggtgcttcttatcacccccctagctgaggttgcttgccacttaggttatgacactatgcattaatatttagagagttttttttcccaaaaaaatagaaggcagttgttagcttgatgatacaatctattctgtgggcttttgatgtgctggggtttaaaagttagctctctccttttttgttataatttttttttgtctgatttgattgtgttctggaaaggtctctttccgtacaaaggttttccaccccaacatcaacagcaatggaagcatttgtcttgatattctcaaagaacagtggagccctgctcttacaatatccaaggtataattatctcttcgatcatgctttcttttgtctctctctgaacatgggatgttgtgttaaagttatatagtactataatattgatgctagatctgcattatagttttatatttgtcgcattaatgacattggatttgcataattgttttaagacggaatatctctctcttgtaggttcttctgtccatctgttcactgttgactgatccaaaccctgatgatcccctggtgcctgaaattgctcacatgtacaagacagacagattcaagtatgaaaccactgctcggtcttggacccagaaatatgccatgggctag

SEQ ID NO: 492 - DNA, 1343 bp, Populus balsamifera subsp. trichocarpa
  misc_feature (1)..(1343): Ceres ANNOT ID no. 1533218
  misc_feature: Encodes the peptide sequence at SEQ ID No. 252
tggcttcaaaacggattaacaaggaattgagggacttgcagaaggatcctcctactgcttgcagtgcaggtttgtcactaaacttgttctaaaaaagttttttctaagtagaaactaatgtgctaccagtttctttgatgaaaaaagagatttatgtgtcatgttggtttttcttctcctgatttgaatataataatgatgttatactgttaggccctgctggtagtgacatgttccattggcaagcaacaattatgggtccagcagacagcccatacgctgggggtgtgttctctgttaacatacacttccctcctgattacccattcaagccacccaaggtactaacaaaagtagtcactatcttttgtatttgatatgtttaaggtgcaccatggatttggtttatttagctgtttgttctaagctagattttgagattctctttcttgtttagaagagatattaacttaagcatgggattctatccatttacaagaagtcctttcatcataccagaatgtccctgaaaggacatgttcatgacaattcatgtatcgattcatctgcacagatgtatgtttcctttctttctcacaatggacaaattctgatgtgagcaaagttatagtatgtgctcctcgtaatctgatgtcgcaaatattccttgcttctgtttcctttgtactgatgttgttgaccttaggatttttacagcctctgttttattagtgatctagtcacctcacatgacagcagaattgtccttccattctaccaaaatgaaaacccatgaatgtccctgtttattagtaatccagtcacttcaatgttacttaagtcacttgaaagagttggttttgttagattttgtttacttagttatattttgaacaacaaaatgaactgatgtatgcaaaatagatatttactattgaatgaaatactttgtgcaggtttcctttaagacaaaagtttatcatccaaacattaacagcaatggcagtatctgtcttgacattctcaaggagcaatggagcccagccttgacaatttcaaaggtctccatcactatcttcacttctcttcaaactccaaaatttaaaataagtcctgtgtatttgccatagtttcaatttgaattagtcttgggctttatgattgtttctgttttgcaaatcttttatgtttctttgcaggtgttgttgtcgatatgctcgctgttgacagatccaaatcccaatgatcccctggtgcctgagattgctcatatctacacgactgatagagtcaagtatgatgctactgctcgagcctggactcagaaatatgctatgagctag

SEQ ID NO: 493 - DNA, 1298 bp, Populus balsamifera subsp. trichocarpa
  misc_feature (1)..(1298): Ceres ANNOT ID no. 1467033
  misc_feature: Encodes the peptide sequence at SEQ ID No. 335
taccgacaacttcgttccgtggagttagagaagggaggagttgagtattcgtcgtccaaccaaaaccatgggaaaaccggacagatgtgtgtatacaaagtttctgaaacgagaatgctcacaaatatagtagattacgacaaaacatactacttaaacgtccctttattgcttggggtaacttcgtttatgtttatacatgttgtgggtttaccctataccacacggtaatagtcctccttgatgttgctgttgtcgactatgtgaagaaggatacatgtcaagacactagtgactaagttagagggtattttgtggttagtttagtctgtcaccagagtgaatgttgcagggacatgtttctttcgcgggttctctgagatagttaggagaggagagtataggttgagatcatgttaggttattctgaacgcgagggaagaggaaagaaccggttctggagagaaaagtctaggttgttgtcgttaatctgtagctaacggaacaaagagttgtacattcaagtagtgaagtaattttagtgttaagataagtggaagaaaagagaaaggaaaagaaaaatactaatcgtataacgtaacgggataacggttagagtataacatatataaatgaaatcgtattcaacataactacaaaaaaaaaaaaaaacaataaaacaaaatctacctctttcattcctacctctatcttctcttctcctcctccgttcgttcctcctattatctccgttatctctgtccctactacttctctgattctcgttttcttcttctttaacttttctatccgtttaacttaacccgggagcttctctttcagttcagaaacacgcatctcttggtttatacctctctgaaccgtgttaggttgcttcgttgtcggttatgagatgcaaggttagaacttgttcaggaacgtcgtgtccaattccttctggcgtgggaaccacgtcctaacctactagtctgtcgtcgtaatgacctgctacgggttagtacaacaccatcgttaccaccactaccactactacctacccttctttttcacagcctctccacgtgcaatcgtttaccccgcgtcctgttattaccacgtccaggttccccatgtccatgttcatcaaccaacacgtccttgacattgttccgtctcagaacacacaacgacaacggaacatccgtagacacgaacacatgacaaacacccagttcagaggtatgaacggggtagacatttcggtggttcttacgatcacaggtacaattgaacagtac

SEQ ID NO: 494 - DNA, 1233 bp, Populus balsamifera subsp. trichocarpa
  misc_feature (1)..(1233): Ceres ANNOT ID no. 1536919
  misc_feature: Encodes the peptide sequence at SEQ ID No. 337
tggccgttgaagccaggcacctcaatctcttccctcctcaactcttaagcaacaggttggtgttgcactattgctacccctttggcgtactcttcttttcatgagtgtttagccgtctaatgttgtttttggtgatgaatttgcagggaaatgatgatgaaccccattgaagcagatacatatatgtacaacacccagatgggatatggtgtgccattatcaggaactacaacaacagcagagacagtgcttcctatgtatagctctgtgatcactgattcaatccctcataaaacgcaaatcaaatcagaaagtggtctcacttacaatctccctgtacagaggaagcgcccaagagacaccatcaatcctctcctctcatatccaattccagtacagtccactaagacttgcactcccttctcctttcttggccaggacctctcttttcagatccaacaacagcaattagacacagattgccttatttctcaacatgtaagtccatcacttcattaaattcataattctgttattgtcttttttttttcaatgattagcatatatatcgcattgtcctatttagggaatgatattaattttaatgtttttggttgttttgtttagatggagaaagtaaggatggagatagaagagaaaaggaagaggcaggcaagaaggttactcgaggcattagagacagggatggtgaagcgactaagagcaaaagaagaagaaatcgaaaagataggcaaattaaactgggcccttgaagagaaagtcaagtctttatgcatggagaatcaaatatggagagacctagcgcaatccaatgaagcaacagccaatgctctacgttccaatcttgaacaagtcctcgcagcccaggttaacgaagaacgcacccttggtgcaggattagataatcaggcagcagcattaatggacgatgcgcaatcatgctgtggcagcagcggtggtgatggacctgttggcgacgatggatgggaagaaagagtgtcggagagatgcacgttagccaatggggcgcaggataataaaggtacaggagcaggtagttggatgtgcaggaattgtaacaaggaagagtcatgtgtgttgctgttgccttgcaggcatctgtgcttgtgtactgtttgtgggtcaagcctccatacttgccccatctgtagagccaccaagaatgctagcgtccatgttaacttgtcatga

SEQ ID NO: 495 - DNA, 1283 bp, Populus balsamifera subsp. trichocarpa
  misc_feature (1)..(1283): Ceres ANNOT ID no. 1485102
  misc_feature: Encodes the peptide sequence at SEQ ID No. 350
tggagcagcagcctcagcaacagaaccagctaacggtgcaaaactcaggcagccttagctttagcagccaaatgtctaaagaagatgaagagatgtcaaggtctgctctctctacttttagagccaaagaagaagagatcgaaaagaagaaaatggaggtcagagagaaggttcaagctcagttgggccgtgttgaggaggagaccaagcgcttagccatgattcgtgaggtactacgcacttcaattaatttgtatatttctgcaattctcttgatttcattcttttaatctcaagttttgttgtgactaattaaatgatatttctcactgatctaaaccagccaaaaacattgacatgaatttcttagaaacacctagggttttgatgccaaaagaaagacttttttcaacttcaaaaagtacagatgcaattactaattttggtttttttttcataaatttactacaagaactgacgagattaaccttgcctgattaatgtttttcaagtcaacgacatgaaacaggctgtgagacttaaaagctcaaaaacctctactattagtactaatttttttttatggatgtaattgggtttttgctttataaactgtccgtccttgacacgaaagatttgtatttttatctggtaaagcttccgggcttcaattaatttataaatctacctgcaggagcttgaagcgcttgcagatcccatgaggaaggaagttgctgttgtccgcaagaagattgatacagtgaacaaagaattgaagccattaggacatactgtgcagaagaaggtaaaatttcatatggataaaaattaattcaattatctggatttatttgtgtgtgtgttatcaccccgaatggcacaggacaatccatatagcctaccctaactagttagtttgcaattgaggcttggttgttcttgttgtgtgtgctgctcgctcatggagaggaccattgaattgggatttatgttttgccgcaggagaaagaatacaaggatgcccttgaggccttcaatgataagaacaaggagaaagtacagctcataaccaaattaatggaggtgagtttcatatttggttctatttatacgagttcatgaaactaaagcagaaataatggaaattgaaagcctgtatatgctctttttttctaatttaaattccttatgtctttgagtttgaacagctcgtgagtgaaagcgagaggttgaggctgaaaaagctggaggagctgagtaagaacatagactccatgcactga

SEQ ID NO: 496 - DNA, 3734 bp, Populus balsamifera subsp. trichocarpa
  misc_feature (1)..(3734): Ceres ANNOT ID no. 1499194
  misc_feature: Encodes the peptide sequence at SEQ ID No. 368
taccgctgtcatggtcctgttgactataccctctatcaattcttcttattgacgaaaaaccacttcgtcaaaccttctccttgacgatcggaagccaagtcgtttctctcgttgttagagatgttggaattgagaatgttcgtgagaccatgagagagagacacacacacacacgcacgcacggacgaacagacagagagaatgtgatagcaccaattacaaaagagaattccctgacacacgatccaaaacaaactagactcaactcccgaactaaatcaactacaaaccagaactttcgaaaataaaaactcccttacctcttcttatccttccctttttcaattggtaccaccaaaagaggaagtaattgactggtctatacaaaacaaaacgaagttaaactccaacgtcttgtattctactatttatatactagttagaaacatacagttaagtggacaaaactacactaatacgtaattattcaatatcgaacaacctaaagactaactactgaaacattacaaaccaaaaatttattaaacctttagttagttgactccaaaattagaataaaataacaaacagttggtccaaaccgtttgttcttttgacagtggtaagtccgacccctgttcctagttcgacaccaagaacgatgttcattctggttcttcgtcttgtttggtcgtcgaaacaaagtgtttagacagtacttcttcctcaaggcggcgtaccgattccgacacctcttggtccattaataaccagaaagcagtagaacattacgaaaagtacaaacaatgattttaaagaacaaagaatcagtaagtgtagtgagattactactaaaggaaacaaagtcaacaaagacttaccaactttcgacttttaacaggaaagaaagatacgtgaaattaaaaagtctcttaaaaaaaagaaacgttttagttcgtggaggtataatgaccactaaaatacacgggtgaaaaaatataatgtcaccttaaagtttataactttatcaaaaaccttttaaatataatcatgaaaattataggtacaaaacaagttgatttaggtacaaaacaaggtgattgaccaatttcagtacctaaagagacgtcactacttgacaatcgtacattcatctaaacatcccaaagaaactactttatatgaacaatgtgaaccgaagactcgaaatagtaatttcactagacaacactacataccgatcaccagttcaaataattacgtgtggtagctaaagtacacagtaaccacgaacgaaagttataaactcatgttaaagtttatataacttactaaaaaaatcgtatttcacttgcccagaaaaaacttcgaagtatagattataaacaagttaaaagttataactttatttgacgtatttcagtatccaaggatacgtcactactcgagtattgtacattcttctagggaaaacaccccaaagaagacactttatatgaacaatgcgaaccgaagactcgagtcatggacagtatcactaagaaactatacatcatcagaaacaaactaaacgaacatgtacagtacgacgtgattcctttactttgtgaaaatcggtataaccagcttcagtaatctaaagatacgccactactcgacaattgtacattcttcttgggataacacacatcccaaagaagccactttacatgaacaatgcgaaccgaagactcgaaacatgaacatctcaatatcgttatggaactatacaagtttctaagaaggttttagtacaacgtagtaccatccgatagtccaacagtttgtattagtataaactaatctatttaaaaaaataaattagtacaaaaaaatcggtagaaccagcttcagtaatctaaagatacgccactactcgaacaattgtacattcttcttgggataacacacatcccaaagaagtcactttacatgaacaatgcgaaccgaagactcgaatcatgaacatctcaatatcgctatggaactatacataccgaccacagagtaaaaaactaaacaaacatgtacagtacgacgtgattgttttacttcgtcgtagagtgacaaaatacgtgaacgtattaatactcttaactaaaacaaagaatttcaaccaaaaaaaaaagaattttttgaataattatgtgaactaagtaagtcttttttaactcagaccttaactacttagttcacccaaaacgaagttataaatttaggtaaaagtttctaagaaggttttagtacaatatagaaccatccaaaagtacaacaatttgtatttagtataaactaaactatcaaaaaaaaaataaactagtacaaaaaaaaatcggtagcaccagtttcagtaatctacagatacgtcactactcgaacaattgtacattcttcttgggataacacacatcccaaagaagtcactttacatgaacaatgcgaaccgaagactcgaatcatgaacatctcaatatcgctatcgaactatacataccgaccacagagtaaaaaactaaacgaaaaatgtacagtacgacgtgattgttttactttgtcgtagagtaacaaaatacgtgtacgtattaatactcttaactaaaacaaagaatttcaacaaaaaaaaaaagaattttttgaataattatgtgaactaagtaagtcttttttaactcagaccttaactacttagttcacccaaaacgaagttataaatttaggtaaaagtttctaaaaaggttttagtacaatatagaaccatccaaaagtacaacagtttgtatttagtataaactaaactattaaaaaaaaataaactagtacaaaaaaaaatcggtagcaccagtttcagtaatctaaagatacgtcactactcgaacaattgtacattcttcttgggataacacacatcccaaagaagacactttacatgaacaatgcgaaccgaagactcgaaaacacgtttatcattaaagaactgtacataacatacaaaactgaatacaagccgattacacccacaggaatctatgtggaagtctctaataataataataattaataaactaatattaaatgaacggatgttctatgtacgatcgtcacagatcaatagaaagaacaacacaaagaagtttacgaaacgcgacataacaactctttaagtgcacgaaacgagtaacgtccatcttccattgataatgtccggactagacttctttcgtcgagaacgttccaactcacgacacgtgtcctcagaattccatcggttcagaccacagttcttctccttatctgttccaaacttctaaacgacttcctccactaaactctcggcttatatattcattcatgtgacaacccacaggagaacacagcagcgttttctccttatccattgggaagacagaactccacagaaccctaaaaataaattctaaagctacaacttgttatctctaacactaaaaaggacctattaaagaggacgtcaaaacctataccaatccaagacaaaagaccggagactaagtcttggcaagacaaaagtcaaaaacgaagattcctaagccttttatagtgaaatctttcttaatggtttcccaaataataaataccaatcccaactccttaaagttcgtacccgtggcgttgctcgattagcccaactaaaaatttcgaacgatatttttattcac

SEQ ID NO: 497 - DNA, 1490 bp, Populus balsamifera subsp. trichocarpa
  misc_feature (1)..(1490): Ceres ANNOT ID no. 1439584
  misc_feature: Encodes the peptide sequence at SEQ ID No. 370
tggcgacagtaccaggacaactgatatgggagatagttaagaagaataactcatttttggtgaagcagtttggaagaggaactgctagccttcagtttagcaaagaaaacaacaatctctacaaccttaactcttacaagcattctggtactctctttctttcttacagtgttgtggaaaggaactgtgtgtttgagattttgtttgatctaacattactgcttgatttagttaatttatagagctgcgttgtttctatgttttgttttggaattttttttttagaaaattaagattcggaagggaaaattaagcatggtggtactgaacagatttgttctgtatctccttagcaaaacagaagtgaataaataattgatatttgtttgattgatggttcctgacttcgttatatttggttatttaataattttgaaatcatacaaatgagaatttgctattatttcatcgtgttaaaacagggttggcaaacaagaaaactgtcactattcagcctgcggacaaggatcaagctgtggttcttgctacaaccaagaccaagaagcagaacaaacctgcagctttgcttcacaagtctgtcatgaagaaggagttcagccgcatggccaaggctgtggaaaaccaggtaattagaggtctttcattattttgtaatgctttgaatgttttttccttgtcgctactaactgatatatatggccagtggtgcctagatacatgtcatgtgcttagattcatgtcacattgtactaaatgaagcagcatcttctcattgttttaaccacttgcataattcagagaattgatttgcattttcaagttgccttttcttttattaacacactcgattcattcagcaggaatttatgactaaagtgggtttcacttcaatatttaaatccgattttaaatacctgttgaaattccattttagatgctgcttggttttcaggttgtcaaacatgatatgttttagatgttcaaaaaagtgtatttaatcattgttttatttaactatcttggtccaagtccgagatttatatgcagtgatgagataacatacaagagccctttatttgaaaaaaatgtacctgttacgcttggctcctgacctttgtccaaataatgattttttgacatgtagtatatatttctacttgcccgcacaatacattggagtgcaagattttacctcttctgtccaatttaatcattctgtgttcacacttatcgattgccatgccaacctgtcttttgcagtgtctatagtcatctttcttccatgtttttcaatgacattgagcttgttaataaatttatctgtgttttgctaattgcaggttgcagataacaactacaggcctgatctgaagagagcagcccttgcaaggttgagtgtggtgcacaggagtctgaaggtatccaagtctggtgtcaagaagaggaatagacaagctttgaagaaatga

SEQ ID NO: 498 - DNA, 3484 bp, Populus balsamifera subsp. trichocarpa
  misc_feature (1)..(3484): Ceres ANNOT ID no. 1479767
  misc_feature: Encodes the peptide sequence at SEQ ID No. 378
tacctctcacctcaatcttttcttctgtttgggggaaggaggagacagttagaagttgttgttgttgttgacgggaggagtcattttggaccgggcaattttttctagtattaccaacgtagttatcgtcgaccccaagttaaaccaacccgtgatgtcgagagaaacaattggggtatacacgttgaaaatccgtaaggagtgtgtacccgtcgaaagtaaaccgagacacccggctaaagaccatacaatcaggtcggtcatcaaccgatggtgtcactggcgacgtgtagagcaaaaccggcagcggctggtaaatagcgccgcccccgacgaaagcagtggtaacggcacaaagagtaaccgatacggcgactgtaaccggtggaaagaccactaagggattggttttgtcgatttggtgctcggtaacgacacaaacaacatcccaaaacctaagaactacaacgattattgtacgaagttccaggtacatcccgtaaagaacgactagaaagtccctgcttagtcttcttctgtgcatgtaggttacgaaagaagagaaagaaataccgacaaccgttacaagaaccgatacgtcgacccagaatgtgagtgaatatgtttgaaaaaggtaaaagttcttggtttcgaacactacagatgacacgtttggagtttagaacgaagaaatagagataacggaacgaaaattgcaattgttaagatcgagagagaatgcatgcactttttgggaccagcggcctcccttcagggccacttccgccactgctcctcctccttctcctccgctaacctcttcggtttctcagccgcggttacgggaaaaaacccctttataaacgacgaaacttcttgaacgtttctggatacacctaggatgaaaaccactgcacagatttaacccaacgaaccaagggaaaggacaacaaactatgactaacctacccctctctccaaatgccaccactaagttcacctttacgactagttgagttctacatactagcaccccaggcacgtccacgtaaccccaactacgaattgagccaccaaaaccctcaatgaagcgaaccacacctccgaaaccgagcaccccaaccaccccaattctccgacaccccctaacacttaaaacagaaccgataaacaaaccgatactgataaaactattggtttaaccgagtcaggttgtcttccatgtggtggcacttacctccttgggtggagaactgcggcggcggaccatagttccgaccacgaaatcgggaaaaacggcaatacccgtatggagttcgacattcaagaacaacccgatcgaaattaaagaaaagttcataacaaagcactcatgtgaactgtaatacttaactttaaagttgtatttaaactgaatttttaatcaattaagttaaaggtatattatgaatgtgaaactaaaaaaaaaaattaaaaaaaacagtatattaaaaattgtttgactaacaatgtactttccacaaattacaaaattatataaaaaattaaaattaaaattataaaagtattatacaagtaaaacttaaactttatgacattagtgtcaaaatatcatattgatctattctattctattctatttatccaactagtataatagtatctgtatttgctctcctgtcacctgttgtgagggatactgacgttcacacattttagaagttcagagatccttggacatggacgcacctcggtgcatcaaatgtttaccgatcaaaaactcaaaactaaggaaagttaccgggaggttacgtacctgtcgtttgtaattgacgggagcagactcaaagaagaacttacacaaacaaaccgacctagtccgtctaatactacaatggatcgttgtgaattaattacttttcggttctaatagttataaaataatccccgtacctaaatcactttgcagtttaattacctttatataggttataattacacacgtaaattacttttaacacaccatcgatgacgacgctaacaacaaccttttcgacgttgacgacaaaattaccttgaacttcttgtatagaaattaagaaactttttgtaattaaactagtatcattagaattcaataattaatcattttgttctgagcttctaaaagtactaattggttgctaccgattacaaaacgtctattgaatgtcgtagggaaaacgagaccgtagttagaaaagattgtggagaccacgaccggttccatttaaaaatttaaggttgggaaaaatttcttttactttcgacatgaaaaccactaagcatttcatgggaggatttgagaattaagggaacaaggtttaaataatatcccgaaagagaccctcaagagttagacagttatcaatatggtgtccagtcacgaagtacgacaattacgtatgacgacaatatttaagtggggatcactaacaaaaaggttcgtattacggagatgttcaaatacggtatttaaataaactactaccaaagaacctcacgtaagtttaacctaagtagaactcgggatcggaacatccaggaagtcgtgacctgttacggtgtcatcactagacaactgaacttgtattttccctttgtcataaggtgttcataatacgaagaaattaatctatttctttagcatcagactgttgatactggatagaaaaatacattactaaataaccttacataccttacggcgtagatctgtacaatcatacccgatgttacagacgttaacttaataacttgttcaggtgtttgtgaagaggtgattttcgtgagttcccgtcaggtgtttgtgaagaggtgattttcgtgaggtgattttcgtgagttcccgtcgggtgtttgtgaagaggtgattttcgtgagttcccgttcgtaatataaccaaagcttcatacccacattacgaccgaatactttaataacctttccaacctttcaacgtatttgaaacaggtctgtcttgttccaatgtagaaacaagaagagactgagtactataagacacttggggttcttactatctgactgtgaagttaatacgctaaggcacgtggttttatgtcttgtacttcttctcttcttttcttagaataagtttagtacctttcctttttcttcttttttgtttcgcctatattacaactacctttcctttcttttcttttttctttcacctatattatacaactaaatctctacgatttcctactaaattgagttaatgaccaaattaatataaaaacgtctacaaccacagacatcgttcacctggaaccctacgggaaaaacctcctccattaggtggtcgaaaacatcatcctcgacaacgtcggcgtcaatcaccttataaccgcaagtggtacgaaggtagaggtggaggactgtaggggagtttgttttaccgacagtgacgacgtaaggtaac

SEQ ID NO: 499 - DNA, 3412 bp, Populus balsamifera subsp. trichocarpa
  misc_feature (1)..(3412): Ceres ANNOT ID no. 1486712
  misc_feature: Encodes the peptide sequence at SEQ ID No. 381
tggagagtggagttagaaaagaaaacaatcccccttcctcttctttcagtcttcaacaacaacctcctgcaacaaaccctagcccactgagaaagatcataatggttgcatcgatagctgctggtgttcaatttggttgggcgctacagctctctttgttaaccccatatgtgcaactcttgggcattcctcacacatgggctgctttcatctggctttgcggcccgatttctggcatgttagtccagccaacagtggggtactacagtgaccgatgcacctcccgttttggccgtcgtagcccgtttattgcggcgggggctggttttgttgccatttctgtgtttctcattggctatgccgctgacattggccatctctctggtgattccctcacaaaaacagctaagccacgcgcaattgctgtgtttgtggtagggttctggattcttgatgttgctaataacatgcttcaaggtccatgtagggcatttcttgctgatctttcagggacggatcacaagaagactcgtacagccaatgctttctactctttctttatggctgttggcaatgttcttggctttgcatctgggtcttacactcacttgtacagaatctttccattttcaagaaccaaggcttgtgatgtttactgtgcaaatctcaaatcttgtttcttcatctccattgccttgcttttaacgttgacaattctagctctctcttacgtacgtgaaaaaccctggtcgccggagggaagttccggtgacggaggtaacgaggaggagaaagaggtggagggtggagaagctaaagagtcgacgccagcgcctttttttggggaaatagtcgctgctcttaagaacttgcaaagacctatgaggatcctccttttggtgacgtgtctaaactgggttgcgtggtttcctttcttgttgtttgatactgattggatggggagagaggtgtacggtggtgattcaagtagaaatgctgatcaactgaagatgtatgatcgtggggtccatgcaggtgcattggggttactgcttaactcggtggttttgggattcacttcacttggtgtggaggttttggctcgtggggttggcggggttaaaaggctgtgggggattgtaaattttatcttggctatttgtttggctatgactattttgatcaccaaagtggctcaatctaacagaaggtacaccaccgtgaatggaggaacccacctcttgccgccgccatctggtgtcaaggctggtgctctagccctttttgctgttatgggcatacctcaagctgtaagttgttgttggcttgctttaattctcttcatgtattgttttgtgagtagtaattgaagtcagcctttttggtgcaggtcatctagtttttttttttttttgcatgctcaactgtatcatttttgtcttttactctccttttttgcctttttgttataaaattttattttgaatctggaattttccttttacgtttctttcttcacataaacgtttcctttccctttcccttttttccttttgttttaaattacttgacagttatgaattaaatttttaacataaacttgactgtaaaatcctgttaatcattggtataaattttttacataaacttgatgaagttgttaatcttgctgttgaaatatgtaattgggatttcatagtgtaattagataaggtgcacaacacccccttcggcggcaacagtgtaaatttttcaagcctctagtaacctgtctcctgctcgtgcatggagccacgtagtttaaaactggcaaattttcagagttttggttcctttcagatttcaatggccatccaatgcatgaacaccaaataataaatgcccccgtgggagtgaatgtgtgtttttttggctggtttaggcagcttatgattcttatctgatctttacaaaacttaatgaatgaaaaatcaagaccctttgttttcttctcccgtctccttttgttcttgatcaaccgcaagaaggtcaaacgtacgtgtagttcaacttgcacaagcacagccccctttatcaatgtatctgtgtgcatttaatgagaactggttgattggtagctgctgctgtaattgttgttggaaatgctgcagatgctccttttcgtttaaggattggagatttttcatgatgaactaatggtggcagttattatgcagataacttacagcatcccttttgctttggcatccatcttttctaacacttcgggtgctggccaaggtaagttttttagttccaagcagtacttctgctaaggtatcctcctaaattattaatttccttgtttcaatttgattatagggctttctcttggagttctcaatctttcaatagttataccacaggtcagtatatacacttcatgctaatacatgttgctgctataaattcactctagggattgtttttccatgcccgtttctgtttccaagcattaagcctccacaagtttgtgccttcattttattttgatgatggttgttttaagcaagtccttcagtactactggacaatgccacagtaatgatctgtgaatctggaaaggaaaaaaaaatattcaacaagtattttgcttctttaggatcaaaattgataaagaaatcatcagtccgatgataacctatcttcttctgtcatgattaaacggaatgtttgttagagaagcacacctagacatgggctacgatgtctgctgctcttggagttattgaacaggtctacaaacactttttcactagaaagcactaaagggaaagctttggattggattcgaagtatggatgcagtgctggcttctgaaattattgttaaaaaaggatgcataactttttatagacagaacaaagttctcttgactcatgatcatattctgtgaaccccaagaacgatagactgacattataaccataccattaaaaaattaaaaacaagaagaaaaagaagcgaatctcattcaattcaatgtagtgaagggagagaaaaaagaaagcaattaactctcagttatttaattgattggtgaccgccacatcttgaatttagtttacaaatgattagattagattcatatgtactgcagtatactagaatatgtgcaacagttaattctgaataaatgaatggtaattttaacttgattattgttttaatgatgttatggcagatggtggtttctgtagcagctggaccttgggatgccctttttggaggaggaaatctaccagcttttgttgtaggagcggttgcagctgcagccagtggaatattggcattcaccatgcttccatctccgccccctgacatcccctcaaacaagagggctgccaccagtagtagtgctgcattccattga

SEQ ID NO: 500 - DNA, 1080 bp, Populus balsamifera subsp. trichocarpa
  misc_feature (1)..(1080): Ceres ANNOT ID no. 1476735
  misc_feature: Encodes the peptide sequence given in SEQ ID no. 502
atggcgaaggtaactgtgttgctttgtttttgcattctagcagtctttggttctgttaatgcccacacaggaaaggaaaaggttggtatctatgagcttaagagaggagatatgtccttgaagtttaccaattggggggcaactcttgtctccttcgttctccctgacaaaaatggaaagctgattgatattgttcttggatacgatacaattaagcaatacaagaacgatacaacatattttggagccattgttggacgagtcgctaacagaattaagggtgctcaatttaagctaaatggacacacatataagctagttcctaatgaagggaaaaacatgcttcatggtggtccaaagggatatgctgatgttgtttgggaagtgaccaagtatcagaacaagggtcataaacctcacattgtttttagctatcacagttttgacggggaagaaggatttcctggagagatactagtcactgtcaggtatactctccttgcagataaccaagtgacagttgtaatgaaagccaagaatattggtaacaaggcaacccctgtaaatattgccaaccatgcttactggaacctgggaggtcataacagtggcgacatcttgtctgaaaagattcagatttttgcgtccaattacacacctgttgataacgaccttattccaactgggaaaatcgaagctgtgaagggaactccatttgatttcctcaaacccgaggccattggaagcaggaccaggcaacttcctaaaggttatgatatcaactacgctcttgatggagttcatggtggcaagattaggaaagcagcagtgttgcaagacgagaagtccggaattgaaatggagctctcgacaaacgcccctgggttgcaattctatactggtaacatgatcaaggatgtgaagggaaaagctggatttgtgtacaaggctcatgcagctctatgcttggagactcaatggtatcctgactatgttaatcaacccgacttccctcaatctattgtggagcctcgaaagaattacaaacatgtaatgttgtacaaattttcatcacattaa

SEQ ID NO: 501 - DNA, 1537 bp, Populus balsamifera subsp. trichocarpa
  misc_feature (1)..(1537): Ceres ANNOT ID no.1476735
  misc_feature: Encodes the peptide sequence given in SEQ ID NO. 502
tggcgaaggtaactgtgttgctttgtttttgcattctagcagtctttggttctgttaatgcccacacaggaaaggaaaaggttggtatctatgagcttaagagaggagatatgtccttgaagtttaccaattggggggcaactcttgtctccttcgttctccctgacaaaaatggtaggcattgttactcttctgttcatctcaatcatgttcttgatttatggcctttgggtagaattagaggctccatattctctcttttaagtgtttgtcctcttttccactcttttctctggtgtgtcacaggaaagctgattgatattgttcttggatacgatacaattaagcaatacaaggtagggtttcacatcttcattaatttgtagctacctttgtttttgaaagaaaggaggagagctgagggagacgcagacaaatcattgggcttggacataaattgtttcattacatacggtttatgttgtgtcctaatgggttttatatccactgattcttcatcttctgacagaaagtttggtaaataaatttgtgcagaacgatacaacatattttggagccattgttggacgagtcgctaacagaattaagggtgctcaatttaagctaaatggacacacatataagctagttcctaatgaagggaaaaacatgcttcatggtggtccaaagggatatgctgatgttgtttgggaagtgaccaagtatcagaacaagggtcataaacctcacattgtttttagctatcacagttttgacggggaagaaggttcctgaatttctgtctcactgcatttctttaagataaagatttactccatgtcaatagcatcttaattttttttccaagaaaaaatggtgaagattgttcgttctccttttttggaactctgcaggatttcctggagagatactagtcactgtcaggtatactctccttgcagataaccaagtgacagttgtaatgaaagccaagaatattggtaacaaggcaacccctgtaaatattgccaaccatgcttactggaacctgggaggtcataacagtggcgacatcttgtctgaaaagattcagatttttgcgtccaattacacacctgttgataacgaccttattccaactgggaaaatcgaagctgtgaagggaactccatttgatttcctcaaacccgaggccattggaagcaggaccaggcaacttcctaaaggttatgatatcaactacgctcttgatggagttcatggtggcaagattaggaaagcagcagtgttgcaagacgagaagtccggaattgaaatggagctctcgacaaacgcccctgggttgcaattctatactggtaacatgatcaaggatgtgaagggaaaagctggatttgtgtacaaggctcatgcagctctatgcttggagactcaatggtatcctgactatgttaatcaacccgacttccctcaatctattgtggagcctcgaaagaattacaaacatgtaatgttgtacaaattttcatcacattaa

SEQ ID NO: 502 - protein, 322 aa, Populus balsamifera subsp. trichocarpa
  misc_feature (1)..(322): Ceres ANNOT ID no. 1476735
  misc_feature (1)..(318): Pfam Name: Aldose_epim Pfam Description: Aldose 1-epimerase
  misc_feature (1)..(322): Functional Homolog of  Ceres  ID no. 41573 at SEQ ID NO. 81 with e-value of 2.00E-96 and BLAST sequence identity of 63.8%
MSLKFTNWGATLVSFVLPDKNGKLIDIVLGYDTIKQYKNDTTYFGAIVGRVANRIKGAQFKLNGHTYKLVPNEGKNMLHGGPKGYADVVWEVTKYQNKGHKPHIVFSYHSFDGEEGFPGEILVTVRYTLLADNQVTVVMKAKNIGNKATPVNIANHAYWNLGGHNSGDILSEKIQIFASNYTPVDNDLIPTGKIEAVKGTPFDFLKPEAIGSRTRQLPKGYDINYALDGVHGGKIRKAAVLQDEKSGIEMELSTNAPGLQFYTGNMIKDVKGKAGFVYKAHAALCLETQWYPDYVNQPDFPQSIVEPRKNYKHVMLYKFSSH

SEQ ID NO: 503 - protein, 113 aa, Gossypium hirsutum
  misc_feature (1)..(113): Ceres CLONE ID no. 1798334
  misc_feature (17)..(112): Pfam Name: Ribosomal_60s Pfam Description: 60s Acidic ribosomal protein
  misc_feature (1)..(113): Functional Homolog of  Ceres  ID no. 25429 at SEQ ID NO. 94 with e-value of 7.99E-38 and BLAST sequence identity of 76.7%
MKVVAAYLLAVLGGNLSPSADDLKDILGSVGAEADDDRIELLLSEVKGKDITELIASGREKLASVPSGGGAVAAAPTAGGGGASAAPAAEAKKEEKVEEKEESDDDMGFSLFD

SEQ ID NO: 504 - protein, 113 aa, Gossypium hirsutum
  misc_feature (1)..(113): Ceres CLONE ID no. 1886478
  misc_feature (17)..(112): Pfam Name: Ribosomal_60s Pfam Description: 60s Acidic ribosomal protein
  misc_feature (1)..(113): Functional Homolog of  Ceres  ID no. 25429 at SEQ ID NO. 94 with e-value of 9.50E-35 and BLAST sequence identity of 76.3%
MKVVAAYLLAVLGGNASPSADDLKNILASVGADAEEERLQLLLSEVKGKDITELIASGREKLASVPSGGGVAVVASAPGGAAAAAPAAAQTKKEEKVEEKEESDDDMGFSLFD

SEQ ID NO: 505 - protein, 114 aa, Musa acuminata
  misc_feature (1)..(114): Ceres CLONE ID no. 1727128
  misc_feature (17)..(113): Pfam Name: Ribosomal_60s Pfam Description: 60s Acidic ribosomal protein
  misc_feature (1)..(114): Functional Homolog of  Ceres  ID no. 25429 at SEQ ID NO. 94 with e-value of 6.89E-32 and BLAST sequence identity of 72.9%
MKVIAAYLLAVLGGNSHPSAGDITSILESVGAEVDVKRINLLLSEVEGKDITELIAAGREKFASVPSGGAVAAVSVAGAGGAAAGAAPAEEPKKEEKVEEKEESDDDMGFSLFD

SEQ ID NO: 506 - protein, 114 aa, Parthenium argentatum
  misc_feature (1)..(114): Public GI no. 730583
  misc_feature (17)..(111): Pfam Name: Ribosomal_60s Pfam Description: 60s Acidic ribosomal protein
  misc_feature (1)..(114): Functional Homolog of  Ceres  ID no. 25429 at SEQ ID NO. 94 with e-value of 3.30E-32 and BLAST sequence identity of 66.0%
MKVIAAFLLALLGGNTSPTDEDLKSILASVGADADDDKIELLLSQVKGKDITELIASGRERLASVPSGGGVAVAAAAGGGGGDAPAAAAEEPKKEEKSEEESDEELGFSLFDDN

SEQ ID NO: 507 - protein, 89 aa, Panicum virgatum
  misc_feature (1)..(89): Ceres CLONE ID no. 1777369
  misc_feature (1)..(72): Pfam Name: CKS Pfam Description: Cyclin-dependent kinase regulatory subunit
  misc_feature (1)..(89): Functional Homolog of  Ceres  ID no. 5750 at SEQ ID NO. 111 with e-value of 1.70E-37 and BLAST sequence identity of 96.1%
MGQIQYSEKYFDDTYEYRHVVLPPEVAKLLPKNRLLSENEWRAIGVQQSRGWVHYAIHRPEPHIMLFRRPLNYQQQEAAAAAAAQMLPK

SEQ ID NO: 508 - protein, 94 aa, Musa acuminata
  misc_feature (1)..(94): Ceres CLONE ID no. 1744578
  misc_feature (1)..(72): Pfam Name: CKS Pfam Description: Cyclin-dependent kinase regulatory subunit
  misc_feature (1)..(94): Functional Homolog of  Ceres  ID no. 5750 at SEQ ID NO. 111 with e-value of 5.49E-39 and BLAST sequence identity of 95.0%
MGQIQYSEKYFDDTYEYRHVVLPPEVAKLLPKNRLLSENEWRAIGVQQSRGWVHYAIHRPEPHIMLYRRPLNYQQQQENPAAAAAAHAAQVLPK

SEQ ID NO: 509 - protein, 88 aa, Gossypium hirsutum
  misc_feature (1)..(88): Ceres CLONE ID no. 100008703
  misc_feature (1)..(72): Pfam Name: CKS Pfam Description: Cyclin-dependent kinase regulatory subunit
  misc_feature (1)..(88): Functional Homolog of  Ceres  ID no. 5750 at SEQ ID NO. 111 with e-value of 1.80E-40 and BLAST sequence identity of 94.2%
MGQIQYSEKYFDDTYEYRHVVLPPEVAKLLPKSRLLSENEWRAIGVQQSRGWVHYAIHRPEPHIMLFRRPLNYQQQQENQAQQAMLAK

SEQ ID NO: 510 - protein, 94 aa, Musa acuminata
  misc_feature (1)..(94): Ceres CLONE ID no. 1723582
  misc_feature (1)..(72): Pfam Name: CKS Pfam Description: Cyclin-dependent kinase regulatory subunit
  misc_feature (1)..(94): Functional Homolog of  Ceres  ID no. 5750 at SEQ ID NO. 111 with e-value of 1.10E-38 and BLAST sequence identity of 93.8%
MGQIQYSEKYFDDTYEYRHVVLPPEVAKLLPKNRLLSENEWRAIGMQQSRGWVHYAIHRPEPHIMLYRRPLNYQQQQENPAAAAAAHAAQVLPK

SEQ ID NO: 511 - protein, 445 aa, Panicum virgatum
  misc_feature (1)..(445): Ceres CLONE ID no. 1796001
  misc_feature (33)..(432): Pfam Name: Aa_trans Pfam Description: Transmembrane amino acid transporter protein
  misc_feature (1)..(445): Functional Homolog of  Ceres  ID no. 218626 at SEQ ID NO. 136 with e-value of 1.19E-208 and BLAST sequence identity of 85.8%
METQAPGNSSPPKDGRSAEEKAVEDWLPINASRNAKWWYSAFHNVTAMVGAGVLGLPYAMSELGWGAGIAVLVLSWVITLYTLWQMVEMHEMVPGRRFDRYHELGQYAFGEKLGLWIVVPQQLIVEVGVNIVYMVTGGTSLKKFHDTVCEDCKSIKLTYFIMIFASVHFVLSQLPNFNSISGVSLAAAVMSLSYSTIAWGASVDKGKLEDVDYSLRATTTPGKVFGFLGALGTVAFAYAGHNVVLEIQATIPSTPEKPSKKPMWRGVVVAYIVVAVCYFPVSLVGYWAFGNRVDSDILITLSRPKWLIALANLMVVIHVIGSYQIYAMPVFDMIETVLVKRLKFPPGLTLRLIARTVYVAFTMFIAITFPFFDGLLSFFGGFAFAPTTYFLPCIMWLAIYKPKRFSLSWFTNWICIVLGVLLMVLAPIGGLRNIILNAKTYKFYQ

SEQ ID NO: 512 - protein, 143 aa, Zea mays
  misc_feature (1)..(143): Ceres CLONE ID no. 1458107
  misc_feature (5)..(136): Pfam Name: Ribosomal_L28e Pfam Description: Ribosomal L28e protein family
  misc_feature (1)..(143): Functional Homolog of  Ceres  ID no. 5426 at SEQ ID NO. 359 with e-value of 2.99E-61 and BLAST sequence identity of 87.4%
MATVPGQLIWEIVKTNNCFLVKQFGRGNAKVQFSKETNNLCNLNSYKHSGLANKKTVTIQAADKEQGVVLATSKTKKQNKPKISVNKSVLKKEFPRMSKAVANQVVDNYYRPDLKKFALARLSVISKSLRVAKSGAKQRNRQA

SEQ ID NO: 513 - protein, 150 aa, Gossypium hirsutum
  misc_feature (1)..(150): Ceres CLONE ID no. 1932511
  misc_feature (5)..(136): Pfam Name: Ribosomal_L28e Pfam Description: Ribosomal L28e protein family
  misc_feature (1)..(150): Functional Homolog of  Ceres  ID no. 5426 at SEQ ID NO. 359 with e-value of 1.10E-54 and BLAST sequence identity of 76.2%
MATVPGQLIWEVVKKNNCFLVKQFGRGTAGVRFSKEPNNLYNVNSYKHSGLANKKTVTIQPAGKDQSVLLATTKSKKQNKPSSLLHKSVMKKEFPRMAKAVKNQVADNYYRPDLTKAALARLSAVNRSLKVAKSGVKKRNRQASRIHGRK

SEQ ID NO: 514 - protein, 150 aa, Gossypium hirsutum
  misc_feature (1)..(150): Ceres CLONE ID no. 1850967
  misc_feature (5)..(136): Pfam Name: Ribosomal_L28e Pfam Description: Ribosomal L28e protein family
  misc_feature (1)..(150): Functional Homolog of  Ceres  ID no. 5426 at SEQ ID NO. 359 with e-value of 7.99E-54 and BLAST sequence identity of 75.5%
MATVPGQLIWEIVKRNSCFLVKEFGRGTAGIQFSKESNNLYNLNSYKHSGLANKKTVTIQPGGKDQSVLLATSKTKKQNKPASVLHKSVMRKEFPRMAKAVVNQVVYNHYRPDLKKAALARLSAVNRSLKVAKSGVKKRNRQAVRIRGRK

SEQ ID NO: 515 - protein, 150 aa, Gossypium hirsutum
  misc_feature (1)..(150): Ceres CLONE ID no. 1835707
  misc_feature (5)..(136): Pfam Name: Ribosomal_L28e Pfam Description: Ribosomal L28e protein family
  misc_feature (1)..(150): Functional Homolog of  Ceres  ID no. 5426 at SEQ ID NO. 359 with e-value of 1.00E-53 and BLAST sequence identity of 75.5%
MATVPGQLIWEVVKKNNCFLVKQFGRGTAALQFSKEPNNLYNLNSYKYSGLANKKTVTIQSGGKDQSVLLATTKTKKQNKPSTLLHKSSMKKEFPRMAKAVKNQVTDNYYRPDLTKAALARLSAVHRSLKVAKSGVKKRNRQALKIHGRK

SEQ ID NO: 516 - protein, 144 aa, Musa acuminata
  misc_feature (1)..(144): Ceres CLONE ID no. 1727213
  misc_feature (5)..(136): Pfam Name: Ribosomal_L28e Pfam Description: Ribosomal L28e protein family
  misc_feature (1)..(144): Functional Homolog of  Ceres  ID no. 5426 at SEQ ID NO. 359 with e-value of 5.19E-50 and BLAST sequence identity of 72.7%
MATVPGPLIWEIVKKNNSFLVKQFGNSTAMVQFSKEPNNLYNVNSYKHSGLANKKSVTIQGGGKDLSVVLATTKTKKQNKPGSLHHRSAMKKEFRKMAKVVINQVTDNYYRPDLTRAALARLSAVHRSLKVAKSGAKKRNRQAV

SEQ ID NO: 517 - protein, 145 aa, Panicum virgatum
  misc_feature (1)..(145): Ceres CLONE ID no. 1767577
  misc_feature (5)..(137): Pfam Name: Ribosomal_L28e Pfam Description: Ribosomal L28e protein family
  misc_feature (1)..(145): Functional Homolog of  Ceres  ID no. 5426 at SEQ ID NO. 359 with e-value of 9.69E-49 and BLAST sequence identity of 71.3%
MATVPDSLIWEIVRKNNSFLVKQFGNGNAKVQFSKEPNNLYNVHSYKHSGLANKKTVTVQPASGKEIAVVLSTTKTKKQNKPASLNHKSVMRKEFRKMAKAVKNQVGDNYYRPDLTKPALARLSAVYRSLQVAKSGVKKKNRQAN

SEQ ID NO: 518 - protein, 148 aa, Musa acuminata
  misc_feature (1)..(148): Ceres CLONE ID no. 1712104
  misc_feature (5)..(136): Pfam Name: Ribosomal_L28e Pfam Description: Ribosomal L28e protein family
  misc_feature (1)..(148): Functional Homolog of  Ceres  ID no. 5426 at SEQ ID NO. 359 with e-value of 8.50E-50 and BLAST sequence identity of 71.3%
MATVPGPLIWEIVKKNNAFLVKQFGNSTAMVQFSKEPNNLYNVNSYKHSGLANKKSMTIQPSGKDLSVVLATAKTKKQNKPGSLYHRSVMKKEFRKMAKVVKNQVTDNYYRPDLTKAALARLSVVHRSLKVAKSGAKKRNRQAVKARN

SEQ ID NO: 519 - protein, 146 aa, Panicum virgatum
  misc_feature (1)..(146): Ceres CLONE ID no. 1778377
  misc_feature (5)..(137): Pfam Name: Ribosomal_L28e Pfam Description: Ribosomal L28e protein family
  misc_feature (1)..(146): Functional Homolog of  Ceres  ID no. 5426 at SEQ ID NO. 359 with e-value of 1.20E-48 and BLAST sequence identity of 71.1%
MATVPGDLIWQIVRKNNSFLVKQFGNGNAKVQFTKEPNNLYNLHSYKHSGLANKKTVTIQPAAGKDSAVVLSTTKTKKQNMPAKINHKSVMRKEFRKMAKAVKNQVSDNYYRPDLTKPALARLSSVYRSLQVAKSGVKKKNRQPKH

SEQ ID NO: 520 - protein, 143 aa, Solanum tuberosum
  misc_feature (1)..(143): Public GI no. 76573317
  misc_feature (5)..(136): Pfam Name: Ribosomal_L28e Pfam Description: Ribosomal L28e protein family
  misc_feature (1)..(143): Functional Homolog of  Ceres  ID no. 5426 at SEQ ID NO. 359 with e-value of 4.10E-50 and BLAST sequence identity of 70.6%
MTTVPGQLVWEIVKKNNSFLVKEFGNGSAGVVFSKEPNNLCNLHSYKHSGLANKKTVTIQPEGKDKSVLLATSKTKKQNMPSSLLNKSVMKKEFRRMAKAVTNQVGDNYYRPDLKKAALARLSVVNRSLKVTKSGAKKRNRQA

SEQ ID NO: 521 - protein, 147 aa, Panicum virgatum
  misc_feature (1)..(147): Ceres CLONE ID no. 1787980
  misc_feature (5)..(139): Pfam Name: Ribosomal_L28e Pfam Description: Ribosomal L28e protein family
  misc_feature (1)..(147): Functional Homolog of  Ceres  ID no. 5426 at SEQ ID NO. 359 with e-value of 1.29E-46 and BLAST sequence identity of 69.9%
MATVPDSLIWEIVRKNNSFLVEQFGNGNGNAKVQFSKEPNNLYNVHSYKHSGLANKKTVTVQPASGKEIAVVLLTTKTKKQNKPASLNHKSVMRKEFRKMAKAVKNQVGDNYYRPDLTKPALARLSAVYRSLQIAKSGVKKKNRQAN

SEQ ID NO: 522 - protein, 147 aa, Oryza sativa subsp. japonica
  misc_feature (1)..(147): Public GI no. 115465181
  misc_feature (5)..(137): Pfam Name: Ribosomal_L28e Pfam Description: Ribosomal L28e protein family
  misc_feature (1)..(147): Functional Homolog of  Ceres  ID no. 5426 at SEQ ID NO. 359 with e-value of 6.89E-48 and BLAST sequence identity of 69.7%
MATVPEPLIWEIVKKNNCFLVKQFGNSNAKVQFTKEPNNLYNVHSYKHSGLANKKTVTIQPSGVKDAAVVLSTTKTKKQNAPAKLYHKSVMRKEFRKMAKAVKNQVSDNYYRPDLTKPALARLSSVYRSLQVSKSGAKKKNRQPTKL

SEQ ID NO: 523 - protein, 147 aa, Oryza sativa subsp. japonica
  misc_feature (1)..(147): Public GI no. 48716267
  misc_feature (5)..(137): Pfam Name: Ribosomal_L28e Pfam Description: Ribosomal L28e protein family
  misc_feature (1)..(147): Functional Homolog of  Ceres  ID no. 5426 at SEQ ID NO. 359 with e-value of 8.69E-48 and BLAST sequence identity of 69.7%
MATVPEPLFWEIVKKNNCFLVKQFGNSNAKVQFTKEPNNLYNVHSYKHSGLANKKTVTIQPSGGKDAAVVLSTTKTKKQNAPAKLYHKSVMRKEFRKMAKAVKNQVSDNYYRPDLTKPALARLSSVYRSLQVAKSGVKKKNRQPAKL

SEQ ID NO: 524 - protein, 143 aa, Triticum aestivum
  misc_feature (1)..(143): Ceres CLONE ID no. 575833
  misc_feature (5)..(137): Pfam Name: Ribosomal_L28e Pfam Description: Ribosomal L28e protein family
  misc_feature (1)..(143): Functional Homolog of  Ceres  ID no. 5426 at SEQ ID NO. 359 with e-value of 3.39E-46 and BLAST sequence identity of 66.1%
MATVSDSLVWELVRKNNCFLIKQFGNSNAKVQFSKEPNNLYNVHSYKYSGLANKKTVTVQPAAEKEMTVVLSTTKSKKQNKPAAFTHKTVMRKEFRKMAKAVKNQVSDNYYRPDLTKPALARLSAVYRSLQVAKSGVKKKNRQ

SEQ ID NO: 525 - protein, 172 aa, Gossypium hirsutum
  misc_feature (1)..(172): Ceres CLONE ID no. 1836904
  misc_feature (9)..(171): Pfam Name: DUF662 Pfam Description: Family of unknown function (DUF662)
  misc_feature (1)..(172): Functional Homolog of  Ceres  ID no. 4829 at SEQ ID NO. 346 with e-value of 1.40E-54 and BLAST sequence identity of 78.6%
MMQIEQQQQQPQQQQNQLMVQNSGSLSFSSHLSKEDEEISKSALSTFRAKEEEIERKKMEVREKVQLQLGRVEEETKRLAVIREELEALADPMRKEVAQVRKKIDAVNKELKPLGNTCQKKEREYKEALDAFNEKNKEKVQLITKLMELVSESEKLRMKKLEELSKNIDSIH

SEQ ID NO: 526 - protein, 168 aa, Gossypium hirsutum
  misc_feature (1)..(168): Ceres CLONE ID no. 1932013
  misc_feature (5)..(167): Pfam Name: DUF662 Pfam Description: Family of unknown function (DUF662)
  misc_feature (1)..(168): Functional Homolog of  Ceres  ID no. 4829 at SEQ ID NO. 346 with e-value of 7.99E-54 and BLAST sequence identity of 77.3%
MMQTEQQPQHQNQLTVQNSGSLSFSSHLSKEDEEISKSALSTFRAKEEEIERKKMEVREKVQLQLGRVEEETKRLATIREELEALADPMRKEVAVVRKKIDAVNKELKPLGHTCQKKEREYKEALEAFNEKNKEKVQLITKLMELVSESERLRMKKLEELSKNIDSLH

SEQ ID NO: 527 - protein, 170 aa, Panicum virgatum
  misc_feature (1)..(170): Ceres CLONE ID no. 1768109
  misc_feature (38)..(169): Pfam Name: DUF662 Pfam Description: Family of unknown function (DUF662)
  misc_feature (1)..(170): Functional Homolog of  Ceres  ID no. 4829 at SEQ ID NO. 346 with e-value of 7.79E-40 and BLAST sequence identity of 58.1%
MQGGGGGVEQQPMQMVLRVKHPTSSSLGDEEEAGEGSSRSALSVFKAKEEQIARRKMEVREKVFAHLGRVEEESKRLAFIRQELEGMADPTRKEVESIRKRIDTVNRQLKPLGKSCVKKEKEYKEVLEAYNEKSKEKALLVNRLIELVSESERMRMKKLEELNKTVDSLY

SEQ ID NO: 528 - protein, 531 aa, Hevea brasiliensis
  misc_feature (1)..(531): Public GI no. 116008246
  misc_feature (35)..(200): Pfam Name: MFS_1 Pfam Description: Major Facilitator Superfamily
  misc_feature (413)..(484): Pfam Name: Sugar_tr Pfam Description: Sugar (and other) transporter
  misc_feature (1)..(531): Functional Homolog of  Ceres  ID no. 7894 at SEQ ID NO. 374 with e-value of 9.09E-188 and BLAST sequence identity of 73.0%
MEADPRKEPKLASSDHPLPPPPPPSSASIRKIVMVASIAAGIQFGWALQLSLLTPYVQLLGIPHTWAAFIWLCGPISGMLVQPIVGYHSDRCASRFGRRRPFIAAGSFAVAVAVFLIGYAADLGHLSGDPIAKSPKPRAIAVFVVGFWILDVANNMLQGPCRALLADLSGSNQKKTRTANALFSFFMAVGNVLGFAAGAYTHLYKIFPFTKTKACDVYCANLKSCFFISIFLLLTLTVLALTYVHEKQWSPEQGNAAAGDAEEEEDGPFESSPMPFFGEIFAALKNLQKPMWILLLVTCLNWIAWFPFLLFDTDWMGREVYGGDSNGTAEQVRLYDHGVRAGALGLMLNSVVLGFTSLGVEVLARAVGGVKRLWGIVNFILALCLFMTILITKMAESNRRFTTVRGGATVPLPPPGGVKAGALALFAVMGVPQAITYSIPFALASIFCNTAGAGQGLSLGVLNLSIVIPQMLVSVASGPWDALFGGGNLPAFVVGAIAAAASGIFAFTLLPSPPPDVPSAKASRAVTAAFH

SEQ ID NO: 529 - protein, 494 aa, Gossypium hirsutum
  misc_feature (1)..(494): Ceres CLONE ID no. 1925996
  misc_feature (19)..(449): Pfam Name: MFS_1 Pfam Description: Major Facilitator Superfamily
  misc_feature (1)..(494): Functional Homolog of  Ceres  ID no. 7894 at SEQ ID NO. 374 with e-value of 4.09E-176 and BLAST sequence identity of 66.8%
MENGYINPAPSPLRKIITVASIAAGIQFGWALQLSLLTPYVQTLGVPHAWAAFIWLCGPISGLLVQPIVGYNSDRCTSRFGRRRPFIVIGALSVSIAVFLIGFAKDIGHHAGDSLKRTTKPRAVAIFVVGFWILDVANNMLQGPCRALLADLSANDHKKMRTANGWFSFFMAVGNVLGYAAGSYSHLYKIFPFTKTTACDMYCANLKSCFTIDIMILLLVTVTAVTTVKEDPFTKQIQDDGSKESTPFIGEMIAAFKSLKKPMWILLLVTCLNWIAWFPFLLFDTDWMGKEIYGGEAKGDAHKIKLYGDGVRAGALGLMINSIVLGLTSLGLEPAGRLIGGVKNLWAIVNFILCACLASTVLITKMAEAWRQHHGSPLTHPPLNITGSALAVFGVLGIPLALTYSIPFALASIYCSSTGGGQGLSLGVLNLSIVIPQMFVSVISGPLDDAFGGGNLPAFVLGSIAAAVSALLAILALPNPPKQVSLSPGMGGGH

SEQ ID NO: 530 - protein, 230 aa, Musa acuminata
  misc_feature (1)..(230): Ceres CLONE ID no. 1728680
  misc_feature (48)..(228): Pfam Name: PsbP Pfam Description: PsbP
  misc_feature (1)..(230): Functional Homolog of  Ceres  ID no. 16403 at SEQ ID NO. 171 with e-value of 1.70E-58 and BLAST sequence identity of 60.2%
MAASHGWLTSLPNQLAVASSVVNHRSAAAASFVVRASSTDASLTEKDCLRRRQVLVGLSSLTAALSRANFASAEDIPENFRAFVDFTDGYAYYYPSDWRDFDYMGHDSAFKDRFAALQHVRVSFIPTEKKDIRDLGSMEEVIFNLVKNIYAAPNQIPSIYEMQERTVDGKNYWTFEYELESPSFSRTAFATIAIGNGRYYTLVVGANERRWTRLRNKLKVVADSFKILDI

SEQ ID NO: 531 - protein, 235 aa, Gossypium hirsutum
  misc_feature (1)..(235): Ceres CLONE ID no. 1807796
  misc_feature (51)..(233): Pfam Name: PsbP Pfam Description: PsbP
  misc_feature (1)..(235): Functional Homolog of  Ceres  ID no. 16403 at SEQ ID NO. 171 with e-value of 8.00E-70 and BLAST sequence identity of 59.1%
MAMNSVSLNWVPPSFTKKANYVTNSTELAPPSAFSSQNSLTYTKETISNEENNCKRRLLLLGVGVITANLLPANSLLAEEIPQNYRAFVDIPDGYSYYYPSDWREFDFRGHDSAFKDRFLQLQNVRVRFIPTDKQDIHELGPIEEVVYNLVNHVYAAPNQMVNILDMQERTSDGKNYYTFEYELTSPNYASASFATIAIGNGRYYTLVVGALERRWRRLRNKLKVVADSFKVLDI

SEQ ID NO: 532 - protein, 232 aa, Panicum virgatum
  misc_feature (1)..(232): Ceres CLONE ID no. 1771837
  misc_feature (73)..(228): Pfam Name: PsbP Pfam Description: PsbP
  misc_feature (1)..(232): Functional Homolog of  Ceres  ID no. 16403 at SEQ ID NO. 171 with e-value of 4.69E-56 and BLAST sequence identity of 52.3%
MASLQNLICSVSKQLVAPNFAVTAKLNGASHSVVPASSSGASSHEKNVTKRQLALLGAGALATGLLKTSSAFAEEVPKNYKSYVDAKDGYSYLYPAEWRDFDFLGHDSAFKDRNLALQCVRVGFIPTDKTDIRDLGPMDEAIFNLVNNVYAAPNQKPSIYDMQERTVDGKNYWTFEYDLEAPGYGVSAFATVAIGNGRYYTLIVTANERRWSRLRNRLKVVADSFKISDLTA

SEQ ID NO: 533 - protein, 232 aa, Panicum virgatum
  misc_feature (1)..(232): Ceres CLONE ID no. 1773482
  misc_feature (46)..(228): Pfam Name: PsbP Pfam Description: PsbP
  misc_feature (1)..(232): Functional Homolog of  Ceres  ID no. 16403 at SEQ ID NO. 171 with e-value of 4.69E-56 and BLAST sequence identity of 51.4%
MASLQNLICSVSKQLVAPNFAVTAKLNGASHSVVSASSRGASSHEKNVTKRQLALLGAGALATGLLKTTSAFAEEVPKNYKSYVDAKDGYSYLYPAEWRDFDFLGHDSAFKDRNLALQCVRVGFIPTDKTDVRDLGPMDEAIFNLVNNVYAAPNQIPSIYEMQERTVDGKNYWTFEYDLEAPGYGVSAFATVAIGNGRYYTLIVTANERRWSRLRNRLKVVADSFKISDLTA

SEQ ID NO: 534 - protein, 413 aa, Gossypium hirsutum
  misc_feature (1)..(413): Ceres CLONE ID no. 1920025
  misc_feature (44)..(331): Pfam Name: SQS_PSY Pfam Description: Squalene/phytoene synthase
  misc_feature (1)..(413): Functional Homolog of  Ceres  ID no. 28635 at SEQ ID NO. 178 with e-value of 9.80E-175 and BLAST sequence identity of 79.2%
MGSLGALMKHPDDFYPLLKLKMAARNAEKQIPSEPHWGFCFSMLHKVSRSFALVIQQLDTELRHAVCIFYLVLRALDTVEDDTSVAADVKVPILIDFYRHIYDPDWHFSCGTKEYKVLMDQFHHVSAAFLELEKGYQEAIEDITLRMGAGMAKFICKEVETVDDYDEYCHYVAGLVGLGLSKLFHAYGSEDLAPESLSNSMGLFLQKTNIIRDYLEDINEIPKSRMFWPRQIWSKYVKKLEDLKDEENSVKAVQCLNDMVTNALLHVDDCLKYMSALRDPAIFRFCAIPQIMAIGTLALCYNNIKVFRGVVKMRRGLTAKVIDRTKSMTDVYGAFYDFSCILKAKVDKNDPNAQKTVSRLDSILKTCRDSGVLNKRKSYIIENQSNYTPFVVVLLFIIFAIFLVNLNPNWPNN

SEQ ID NO: 535 - protein, 413 aa, Polygala tenuifolia
  misc_feature (1)..(413): Public GI no. 110293133
  misc_feature (44)..(331): Pfam Name: SQS_PSY Pfam Description: Squalene/phytoene synthase
  misc_feature (1)..(413): Functional Homolog of  Ceres  ID no. 28635 at SEQ ID NO. 178 with e-value of 2.29E-175 and BLAST sequence identity of 78.6%
MGSLGAVLKHPDDFYPLLKLKLAVRHAEKQIPHEPHWGFSYSMLHKVSRSFALVIQQLDTDLRNAVCIFYLVLRALDTVEDDTSVPTDVKVPILKAFHRHIYDREWHFSCGTKEYKVLMDQFHHVSTAFLELDKGYQEAIEDITQRMGVGMAKFICKEVETVDDYDEYCHYVAGLVGLGLSKLFHASSKEDLASDNLSNSMGLFLQKTNIIRDYLEDINEIPKSRMFWPRQIWSKYVNKLEDLKHEENSDKAVQCLNDMVTNALMHAEDCLKYVSALKDLAIFRFCAIPQIMAIGTLALCYNNVQVFRGVVKMRRGLTAKVIHQTNTMADVYGAFYDFSCMLKSKVDRNDPNATKTLSRLESIQRTCLDSRLINKRKSFVNEGQPTYSSSMVIILFIVLAIILAYLTANPLNS

SEQ ID NO: 536 - protein, 411 aa, Solanum tuberosum
  misc_feature (1)..(411): Public GI no. 5360655
  misc_feature (44)..(331): Pfam Name: SQS_PSY Pfam Description: Squalene/phytoene synthase
  misc_feature (1)..(411): Functional Homolog of  Ceres  ID no. 28635 at SEQ ID NO. 178 with e-value of 1.5E-171 and BLAST sequence identity of 75.98%
MGTLRAILKNPDDLYPLIKLKLAARHAEKQIPPEPHWGFCYLMLQKVSRSFALVIQQLPVELRDAVCIFYLVLRALDTVEDDTSIPTDVKVPILISFHQHVYDREWHFACGTKEYKVLMDQFHHVSTAFLELGKLYQQAIEDITMRMGAGMAKFICKEVETTDDYDEYCHYVAGLVGLGLSKLFHASGTEDLASDSLSNSMGLFLQKTNIIRDYLEDINEVPKCRMFWPREIWSKYVNKLEDLKYEENSVKAVQCLNEMVTNALSHVEDCLTYMFNLRDPSIFRFCAIPQVMAIGTLAMCYDNIEVFRGVVKMRRGLTAKVIDRTKTMADVYGAFFDFSCMLKSKVNNNDPNATKTLKRLDAILKTCRDSGTLNKRKSYIIRSEPNYSPVLIVVIFIILAIILAQLSGNRS

SEQ ID NO: 537 - protein, 411 aa, Capsicum annuum
  misc_feature (1)..(411): Public GI no. 4426953
  misc_feature (44)..(331): Pfam Name: SQS_PSY Pfam Description: Squalene/phytoene synthase
  misc_feature (1)..(411): Functional Homolog of  Ceres  ID no. 28635 at SEQ ID NO. 178 with e-value of 2.2E-170 and BLAST sequence identity of 75.74%
MGTLRAILKNPDDLYPLIKLKLAARHAEKQIPPEPHWGFCYLMLQKVSRSFALVIQQLPVELRDAVCIFYLVLRALDTVEDDTSIPTDVKVPILISFHQHIYDREWHFSCGTKEYKVLMDQFHHVSTAFLELGKNYQQAIEDITMRMGAGMAKFICKEVETTDDYDEYCHYVAGLVGLGLSKLFHASGKEDLASDSLSNSMGLFLQKTNIIRDYLEDINEVPKCRMFWPREIWSKYVNKLEELKYEENSVKAVQCLNDMVTNALSHVEDCLIYMSNLRDPAIFRFCAIPQVMAIGTLAMCYDNIEVFRGVVKMRRGLTAKAIDRTRTMADVYGAFFDFSCMLKSKVNNNDPNATKTLKRLEAILKTCRDSGTLNKRKSYVIKSEPTYSPVLIFVIFIILAIILAHLSGNRS

SEQ ID NO: 538 - protein, 411 aa, Nicotiana tabacum
  misc_feature (1)..(411): Public GI no. 1552717
  misc_feature (44)..(331): Pfam Name: SQS_PSY Pfam Description: Squalene/phytoene synthase
  misc_feature (1)..(411): Functional Homolog of  Ceres  ID no. 28635 at SEQ ID NO. 178 with e-value of 1.9E-171 and BLAST sequence identity of 75.49%
MGSLRAILKNPDDLYPLVKLKLAARHAEKQIPPSPHWGFCYSMLHKVSRSFALVIQQLPVELRDAVCIFYLVLRALDTVEDDTSIPTDVKVPILISFHQHVYDREWHFSCGTKEYKVLMDQFHHVSTAFLELRKHYQQAIEDITMRMGAGMAKFICKEVETTDDYDEYCHYVAGLVGLGLSKLFHASGKEDLASDSLSNSMGLFLQKTNIIRDYLEDINEVPKCRMFWPREIWSKYVNKLEELKYEDNSAKAVQCLNDMVTNALSHVEDCLTYMSALRDPSIFRFCAIPQVMAIGTLAMCYDNIEVFRGVVKMRRGLTAKVIDQTRTIADVYGAFFDFSCMLKSKVNNNDPNATKTLKRLEAILKTCRDSGTLNKRKSYIIRSEPNYSPVLIVVIFIILAIILAQLSGNRS

SEQ ID NO: 539 - protein, 415 aa, Bupleurum falcatum
  misc_feature (1)..(415): Public GI no. 66393825
  misc_feature (44)..(331): Pfam Name: SQS_PSY Pfam Description: Squalene/phytoene synthase
  misc_feature (1)..(415): Functional Homolog of  Ceres  ID no. 28635 at SEQ ID NO. 178 with e-value of 1.69E-170 and BLAST sequence identity of 75.9%
MGSLGAFLKHPDDLYPLLKLKYAVKHAEKQIPPQPHWAFCYSMLHKVSRSFGLVIQQLGPQLRDAVCIFYLVLRALDTVEDDTSISSEVKVPILMEFHRHIYNNSWHFSCGTKEYKILMDGFHHVSNAFLELGKGYQEAIEDITMRMGAGMAKFICKEVESIDDYDEYCHYVAGLVGLGLSKLFHASGAEDLATDALSNSMGLFLQKTNIIRDYLEDINEIPKSRMFWPRQIWSKYVDKLEDLKYEENSAKAVQCLNDMVTNALIHAEDCLKYMSDLRDPANFRFCAIPQIMAIGTLSLCFNNIQVFRGVVKMRRGLTAKIIDRTKTMSDVYGAFFDFSCLLKAKVDHDDPSAKITLSRLEAIQQTCKNSGTLTKSRKSYILENESRYNSVLIAIIFIILAFFYAYLSSNLSNNA

SEQ ID NO: 540 - protein, 411 aa, Nicotiana benthamiana
  misc_feature (1)..(411): Public GI no. 1706774
  misc_feature (44)..(331): Pfam Name: SQS_PSY Pfam Description: Squalene/phytoene synthase
  misc_feature (1)..(411): Functional Homolog of  Ceres  ID no. 28635 at SEQ ID NO. 178 with e-value of 2.5E-169 and BLAST sequence identity of 74.75%
MGSLRAILKNPEDLYPLVKLKLAARHAEKQIPPSPNWGFCYSMLHKVSRSFALVIQQLPVELRDAVCIFYLVLRALDTVEDDTSIPTDVKVPILISFHQHVYDREWHFSCGTKEYKVLMDQFHHVSTAFLELRKHYQQAIEDITMRMGAGMAKFICKEVETTDDYDEYCHYVAGLVGLGLSKLFHASEKEDLASDSLSNSMGLFLQKTNIIRDYLEDINEVPKCRMFWPREIWSKYVNKLEELKYEDNSAKAVQCLNDMVTNALPHVEDCLTYMSALRDPSIFRFCAIPQVMAIGTLAMCYDNIEVFRGVVKMRRGLTAKVIDRTRTIADVYGAFFDFSCMLKSKVNNNDPNATKTLKRLEVILKTCRDSGTLNKRKSYIIRSEPNYSPVLIVVIFIILAIILAQLSGNRS

SEQ ID NO: 541 - protein, 403 aa, Panicum virgatum
  misc_feature (1)..(403): Ceres CLONE ID no. 1749989
  misc_feature (40)..(327): Pfam Name: SQS_PSY Pfam Description: Squalene/phytoene synthase
  misc_feature (1)..(403): Functional Homolog of  Ceres  ID no. 28635 at SEQ ID NO. 178 with e-value of 3.20E-153 and BLAST sequence identity of 69.75%
MGALSRPEEVVALVKLRVAAGQIKRQIPPEEHWGFAYSMLQKVSRSFALVIQQLGPDLRNAVCIFYLVLRALDTVEDDTSIPTEVKVPILQEFYRHIYNRDWHYSCGTNNYKVLMDKFHHVSTAFLELGEGYQKAIEEITRRMGAGMAKFICKEVETVGDYEEYCHYVAGLVGYGLSRLFYAAGTEDLAPDSLSNSMGLFLQKTNIIRDYLEDINEIPKSRMFWPREIWSKYANKLEDFKYEENSEKAVQCLNDLVTNALIHAEDCLQYMSALKDHAIFRFCAIPQIMAIGTCALCYNNVNVFRGVVKMRRGLTARVIDETNSMSDVYTAFYEFSSLLESKIDDNDPNATLTRKRVDSIKQTCRSSGFLKSRGYHLDKSPYKPILLMIVLLLVAIIFGVLYTK

SEQ ID NO: 542 - protein, 403 aa, Oryza sativa subsp. japonica
  misc_feature (1)..(403): Public GI no. 115456049
  misc_feature (40)..(327): Pfam Name: SQS_PSY Pfam Description: Squalene/phytoene synthase
  misc_feature (1)..(403): Functional Homolog of  Ceres  ID no. 28635 at SEQ ID NO. 178 with e-value of 1.60E-149 and BLAST sequence identity of 68.6%
MGVLSRPEEVLPLVKLRVAAGRIKRQIPPEEHWAFAYTMLQRVSRSFALVIQQLGPDLRNAVCIFYLVLRALDTVEDDTSIPAAVKVPILKEFHRHIYNRDWHYSCGTKDYKLLMDKFRLVSTAFLELGQGYQEAIEEITRLMGAGMAKFICKEVETVDDYNEYCHYVAGLVGYGLSRLFHAGGTEDLASDSLSNSMGLFLQKINIIRDYLEDINEIPKSRMFWPREIWSKYVNKLEDLKYEENSEKAVQCLNDMVTNALSHAEDCLQYMSALKDHAIFRFCAIPQIMAIGTCAICYNNVNVFRGVVKMRRGLTARVIDETNTMSDVYTAFYEFSSLIESKIDNNDPNASLTRKRVDAIKRTCKSSCSLKRRGYDLEKSKYNSMLIMVVLLLVAIVLGMIYAK

SEQ ID NO: 543 - protein, 401 aa, Zea mays
  misc_feature (1)..(401): Public GI no. 2463567
  misc_feature (40)..(327): Pfam Name: SQS_PSY Pfam Description: Squalene/phytoene synthase
  misc_feature (1)..(401): Functional Homolog of  Ceres  ID no. 28635 at SEQ ID NO. 178 with e-value of 3.79E-150 and BLAST sequence identity of 68.25%
MGALSRPEEVLALVKLRVAAGQIKRQIPPEEHWAFAYSMLQKVSRSFALVIQQLGPELRNAVCIFYLVLRALDTVEDDTSIPTEVKVPILQEFYRHIYNRDWHYSCGTNHYKMLMDKFRHVSTAFLELGEGYQKAIEEVTRRMGAGMAKFICKEVETVDDYDEYCHYVAGLVGYGLSRLFYAAGTEDLALDSLSNSMGLFLQKTNIIRDYLEDINEIPKSRMFWPREIWSKYADKLEDFKYEENSKKAVQCLNNMVTDALIHAEECLQYMSALKDPAIFRFCAIPQIMAIGTCALCYNNVHVFRGVVKMRRGLTARIIDETNSMTDVYTAFYEFSSLIESKIDDSDPNAALTQRRVDSIKQTCKSSGLVKQRGYHLEKSPYRPMLIMIVLLLVAILFGVMF

SEQ ID NO: 544 - protein, 404 aa, Triticum aestivum
  misc_feature (1)..(404): Ceres CLONE ID no. 706088
  misc_feature (40)..(327): Pfam Name: SQS_PSY Pfam Description: Squalene/phytoene synthase
  misc_feature (1)..(404): Functional Homolog of  Ceres  ID no. 28635 at SEQ ID NO. 178 with e-value of 5.9E-145 and BLAST sequence identity of 65.1%
MGMLSRPEEVPALLRLKLAAGRIRRQIPPQEHWAFAYDMLQRVSRSFALLIQQLGPELRNAVCVFYLVLRALDTVEDDTAIPNEVKLPILRDFYRHIYNPDWLFSCGANDYRVLMDNFRQVSTAFLELGEGYQKAIEEITRRMGEGMAKFICTEVETIDDYDEYCHYVAGLVGYGLSRLFHATGTEDLAPDHLSNSMGLFLQKTNIIRDYLEDINEIPRCRMFWPREIWSKYVDKLEDLKYEENSEKAVQCLNDMVTNALIHAQDCLQYMSALKDNSNFRFCAIPQIMAIGTCAICYNNVKVFRGVVKMRRGLTARVIDETKSISDVYSAFYEFSSLLESKIDDNDPNAALTRRRVDAIKKTCKSSGLLKRRGYDLEKSKYRMPMLIMIMLLLVAIILGVLYGK

SEQ ID NO: 545 - protein, 142 aa, Gossypium hirsutum
  misc_feature (1)..(142): Ceres CLONE ID no. 1839717
  misc_feature (1)..(142): Functional Homolog of  Ceres  ID no. 158765 at SEQ ID NO. 159 with e-value of 5.09E-36 and BLAST sequence identity of 72.8%
MENKRSPCSVDHSSFTPLASKRQKSDLLISTKDRKDKVGERIVTLQQLVSPYGKTDTASVLLQAMEYIQFLHEQVKVLSAPYLQTSPTNNMQEQEHYSLRSQGLCLVPLSYTMGVVHSNGADIWAPIKTASPKFDKPFTQFN

SEQ ID NO: 546 - DNA, 629 bp, Gossypium hirsutum
  misc_feature (1)..(629): Ceres CLONE ID no. 1798334
  misc_feature: Encodes the peptide sequence at SEQ ID No. 503
gtttttcctccgcggctcctttttccttctcgctctctagggttttcgtggtcaagtaaaaaaaatgaaggtggtagctgcctacttgcttgccgtcttgggagggaacctttccccttctgccgatgatttgaaggatattctcggatctgttggagctgaggctgatgatgataggatagagttgctattgtccgaagtcaaaggcaaagatatcaccgagctaattgcatctggaagggagaagttggcttcagtcccttcaggtgggggtgctgttgctgctgctcctaccgcaggtggcggtggtgccagtgctgcaccagctgctgaggccaagaaagaggagaaggtcgaagagaaggaagagtccgatgatgatatgggtttcagcctcttcgattaagccaagtaatgcagatgtcaaggtttttcttatgcggttagtgcttttatttcaagcggtatatgattttgtatgtttgttactctctggtcgaaagttgtttctttatcaacctttaggttcgagttttctttggaaaatgtagttaaagataatccattcaagttgtaactttaattttggattaaaacaaattattatctaaaaaaaaaaaaaaaaaaaa

SEQ ID NO: 547 - DNA, 629 bp, Gossypium hirsutum
  misc_feature (1)..(629): Ceres CLONE ID no. 1886478
  misc_feature: Encodes the peptide sequence at SEQ ID No. 504
gttacctccatttgcatccacaacagctgcggatccattgcttccctgtttcctgtaatcaaaaaagagagaaaatgaaggttgttgctgcttatttgttggctgtacttggaggcaatgcctctccttcagctgatgatcttaagaacattcttgccagcgttggagctgacgctgaagaggaaaggctccagcttcttttatctgaagtgaagggcaaagatataaccgagcttattgcatctgggagggaaaagcttgcctctgttcccagcggtggtggtgttgctgtggtggcatctgcacccggaggagccgccgccgccgctcctgctgcagctcagactaagaaggaagagaaagttgaggagaaagaggaatccgatgatgatatgggcttcagtctcttcgactaaaagcaccgcgcaccgctttccgcgcaccgccagcaacctatgaatgaaatacggatggtttttggtttctacagaggatttcttttgaatttaaggctgccctaggtttttgaagttagttatccagtgccatttagttctttctttgtggattcatatatttgttttgctgaacccttttgttgcaatggaattttcttccgacttaatttt

SEQ ID NO: 548 - DNA, 551 bp, Musa acuminata
  misc_feature (1)..(551): Ceres CLONE ID no. 1727128
  misc_feature: Encodes the peptide sequence at SEQ ID No. 505
gatctcacattctcgcatccaacttgaggccttggcagcggcggcggactcgcaagcagagatgaaggtgatcgcggcgtatctcctcgcagttctcggcggcaactctcatccctccgctggcgacatcacgtccatccttgaatcagtgggagcggaggtagacgtgaagaggataaatcttctcctgtcggaagttgaggggaaggacatcacggagctaatcgccgccggaagggagaagttcgcctcggtcccgtcgggaggcgccgtagcggccgtctcggtcgccggtgctggtggtgctgctgcgggcgctgccccggccgaggagccgaagaaggaggagaaggtcgaggagaaggaggaatccgacgacgatatgggcttcagcttgttcgattgagggggtatcgagtatctatttatgcttagcttacttaaaaatcctttgcttagatttagtcgaggaaaagtggtgtcttgtttccaaattccgtcttatttaaacttttgtgtaagacttgaagaaatatttcttgagttcacgc

SEQ ID NO: 549 - DNA, 706 bp, Panicum virgatum
  misc_feature (1)..(706): Ceres CLONE ID no. 1777369
  misc_feature: Encodes the peptide sequence at SEQ ID No. 507
aacgcgctcccctctcgctgcggctctcatttcggctccaccgcacacgctccaccccgctcctagagaagctgatcgagaagtggtggtggacatgggccagatccagtactccgagaagtacttcgatgacacctacgagtacaggcacgtcgtcctcccgcccgaggtcgccaagcttctccccaagaaccgcctcctctccgagaacgagtggcgtgcgatcggcgttcagcagagccgcgggtgggtgcactatgcgatccaccgaccggagccgcacatcatgctgttccgccgcccgctcaactaccagcagcaggaggcggctgccgcggcggcggcgcagatgctgcccaagtgagccctccggcgagggcggcgaccacagcgggtttgctgcatttaaaacgccaatccccttttgaactcaaaaaggggcgtcgctgtgcttcgattaatctctccgcctgttggttggaatcaagtgactggtgttggaggtgtccgccttgtgttcgtggtaatgcctgtgaaggaactggctgggttaggctgtgcttatcatgagttctcttatactatgtgttatgtgactctggttgacactcttgtttctgatggttctattctggtttgtaatgctgtgatatttagtctgctatgtgatgaagagatgatgatctaaaaaaaaaaaaaaaaaaaa

SEQ ID NO: 550 - DNA, 551 bp, Musa acuminata
  misc_feature (1)..(551): Ceres CLONE ID no. 1744578
  misc_feature: Encodes the peptide sequence at SEQ ID No. 508
atctctctctcctggtctgtgtgacgctctcccccattctaggtgcgatcgatcgaggcggagaagttggagcggaaggaagatcgaaatgggtcagatccagtactcggagaagtacttcgatgacacctacgagtacaggcatgtggtgctccctccggaggtggccaaattactccccaagaaccgtctcctctctgagaacgagtggcgggcgatcggggtgcagcagagccggggatgggtgcactacgcgatccaccgcccggagccgcacatcatgctctaccggcggccgctcaactaccagcagcagcaggagaacccggccgccgccgcagcagctcatgctgcccaagttctccccaagtgatgtactataaccagcagtaataatagcgcaagaagaagaagaagaagaagaagaagaagaagaagaagaagaagaagaagccctcttctctaatccttatgcttgttgaactaatcggaagtagtttgtcttggtttgctaccactacttgtgaaatggcagttctaatttggctttc

SEQ ID NO: 551 - DNA, 447 bp, Gossypium hirsutum
  misc_feature (1)..(447): Ceres CLONE ID no. 100008703
  misc_feature: Encodes the peptide sequence at SEQ ID No. 509
ttttcttttgaataatcccagttttccaatccaatctcagctctccgtctctcttcattttcacactctctcaagttgcttcgctttttgcagatcgaatcctgaaattgaacttggatctctatcggaacaagaaaaccagttgtctcttttaacaaaatcaaaataatgggtcaaattcaatactctgagaaatacttcgatgatacttacgaatacaggcatgttgttcttcctcctgaagtggccaaacttctccctaagagtcgcctcctctctgaaaatgagtggcgtgcgattggagtacagcagagtcgtggttgggtccattatgctattcatcgtcctgaaccacacatcatgttattcaggaggcctcttaactatcagcagcagcaggagaatcaggctcagcaagctatgcttgccaagtaattaaaatagctt

SEQ ID NO: 552 - DNA, 518 bp, Musa acuminata
  misc_feature (1)..(518): Ceres CLONE ID no. 1723582
  misc_feature: Encodes the peptide sequence at SEQ ID No. 510
atctctcactcctggtctgtgtgacgctctcccccattctaggtgcgatcgatcgaggcggagaagttggagcggaaggaagatcgaaatgggtcagatccagtactcggagaagtacttcgatgacacctacgagtacaggcatgtggtgctccctccggaggtggccaaattactccccaagaaccgtctcctctctgagaacgagtggcgggcgatcgggatgcagcagagccggggatgggtgcactacgcgatccaccgcccggagccgcacatcatgctctaccggcggccgctcaactaccagcagcagcaggagaacccggccgccgccgcagcagctcatgctgcccaagttctccccaagtaatgtactataaccagcagtaataacagcgcaagaagaagaagaagaagccctcttctctaatccttatgcttgttgaactaatcggaagtagtttgtcttggtttgctaccactacttgtgaaatggcagttctaatttagctttc

SEQ ID NO: 553 - DNA, 717 bp, Panicum virgatum
  misc_feature (1)..(717): Ceres CLONE ID no. 1796001
  misc_feature: Encodes the peptide sequence at SEQ ID No. 511
acagctctactacctctcctaccccctcctccacctctgtggtctctagctacctccctctccattgctcaagtcgccgcggcatccattgccatggcagtccagccgtccatggagacgcaagcgcccgggaattcttctccacccaaggatggcaggagcgccgaggagaaggctgtggaggactggctcccgatcaacgcgtcgcggaacgccaagtggtggtactcggcgttccacaatgtcacggccatggtcggcgctggcgtgctcggcctcccctacgccatgtccgagctcggctggggcgccggcatcgccgtgctggtcctgtcgtgggtcatcactctgtacacgctgtggcagatggtggagatgcacgagatggtgccgggccggcggttcgaccggtaccacgagctcgggcagtacgccttcggcgagaagttgggcctctggatcgtcgtgccgcagcagctgatcgtggaggtgggcgtgaacatcgtgtacatggtcaccgggggcacctcgctcaagaagttccacgacaccgtctgcgaagactgcaagagcatcaagctcacctacttcatcatgatcttcgcctccgtccacttcgtgctctcccagctccccaacttcaactccatctccggcgtctccctcgccgccgccgtcatgtcgctcagttactccacgatcgcgtggggcgcgtcg

SEQ ID NO: 554 - DNA, 659 bp, Zea mays
  misc_feature (1)..(659): Ceres CLONE ID no. 1458107
  misc_feature: Encodes the peptide sequence at SEQ ID No. 512
  misc_feature (514)..(514): n is a, c, t, g, unknown, or other
  misc_feature (515)..(515): n is a, c, t, g, unknown, or other
atacgctagtctaactctctctttgcgaaatttcacggtttttagaaatggcgacagttccaggacaattgatatgggagatcgttaagaccaacaactgtttcttggtcaaacagttcggaagaggcaacgctaaggttcagttcagcaaggagaccaacaatctctgcaacctcaactcctacaagcactctggtcttgctaacaagaagacagtgaccatccaggcagctgacaaggagcaaggtgttgtcctcgctaccagcaagaccaagaagcagaacaagcctaagatctctgtcaacaagtctgtcctcaagaaggaattcccaaggatgtccaaggctgttgctaaccaggtggtagacaactactacaggccagacttgaagaagttcgctcttgctagactcagtgtcatcagcaaaagccttagggttgccaagtccggtgccaagcaaagaaaccgtcaagcttaagcttttttgttcagaatcttatgtttgaagtaaannattttgctgaagaggtttattaagttgttttctgttgaagttgaatcatagcactatgctccttttcattaagagttttcttatacttatgtttcttgtgtgcttgtgatatgcatttttttgttgaatcttttttatcaaatg

SEQ ID NO: 555 - DNA, 676 bp, Gossypium hirsutum
  misc_feature (1)..(676): Ceres CLONE ID no. 1932511
  misc_feature: Encodes the peptide sequence at SEQ ID No. 513
aacatatcagacctgatccaacgcctaaatccgacactagttcatgcttgggagctatcttattagccaaaagatggaaaacagcaagcaaatcacgtggcgcagtgcgcacgacggtccttaacatattacaggcgacgttcacgtcgttgcggcacacccgttgagtgataaaatcaaacgtccggaagagaaacgagaaaggaaccccatcgctcttagaccaatacgccattgattccgaaatcttctgccgctgttttcaacaaagataccttgcagctattcagttcttcaccagtcatctcttcagactccatgaatcccgaaatattcttctttttctttttcatcatcttcttctccaaataacttccattatcgtcgtcttcgtactggcattgctttaattccagggttttggtgtttagctactgattcagccttgtcagaagcaaatgaatgtgggattttgcgctttttggataatgattggtgtttgctcttcgtaacagcggcggcgttgaaagccgtcgaagccattggtgtctggctctagttttttgtttgttctctctagggtaataaaaaattggcgtaagtgaggtgcagggaaacagaacacaaaatggcgacagttccaggacagttgatttgggaggtagtgaagaagaac

SEQ ID NO: 556 - DNA, 630 bp, Gossypium hirsutum
  misc_feature (1)..(630): Ceres CLONE ID no. 1850967
  misc_feature: Encodes the peptide sequence at SEQ ID No. 514
atccataatcaattaggcgacactaaaccctctctgccgccctcctcccgtactccattgtggtaagtaaatggcgacggttccaggacagttgatttgggagatcgtgaagagaaacagctgtttcttggtgaaggagttcggtcgaggcaccgccggcattcagttcagtaaggagagcaacaatctctacaatcttaactcttacaagcactctggtcttgctaacaagaagactgtaactattcagcctggtgggaaggatcaatcagtgttgcttgccacctcaaagactaagaagcagaacaaacctgcaagtgtgcttcataaatctgttatgagaaaagagtttcctaggatggctaaggctgttgtcaatcaggttgtatataatcactaccgaccggacttgaagaaggcagcccttgcaagacttagtgctgtcaacaggagccttaaggtagccaaatctggggtcaagaagaggaacagacaggcggttaggatccgtggcaggaagtgaaacatagatagttggggaaactgtcatgcctgaattggtgatggttttctttggttacaaaagttgcagacagtagattaatttgtcatttcgtgttaatgtattga

SEQ ID NO: 557 - DNA, 842 bp, Gossypium hirsutum
  misc_feature (1)..(842): Ceres CLONE ID no. 1835707
  misc_feature: Encodes the peptide sequence at SEQ ID No. 515
gcggctccccttttcctattataaaccctaaaaatcaacaggtccttttcctattcttgtctcagtgttattagtttattcttgattttgtttgatttgttttagagtgtttaaatcttactaagggagttgggtattttgtggatctgttgcagagaaaatggcgacagttccaggacagttgatttgggaggtagtgaagaagaacaattgttttttggtgaagcagttcggaagaggaactgctgcccttcagttcagcaaagagcccaacaatctctacaatctcaactcctacaaatactctgggttggcaaacaagaaaacagtcaccattcagagtgggggaaaagaccagtctgtgctactagctaccaccaagactaagaagcagaacaagccatcgaccttgcttcacaaatcttccatgaaaaaggagtttcccaggatggccaaggctgtcaaaaaccaggtgacagacaactactacaggccagacttaaccaaagcggcccttgcaaggctgagtgctgtgcataggagtctgaaagttgccaagtctggtgtcaagaagaggaacagacaagccttgaagatccatggcaggaagtaagctagacagtttaagttgtattgtgctgcggtttccgttgttctagacagaccccccttttttttattgttttacggaattttgaaattgtgttattgtcaaccatggttgtagctagggtggtggattaggtgtctagatttttgaagcagagattcatggtcctttgccagtttgatttctgaattataacatggtaatttttagcgaaaaaaaaaaaaaaaaaaaa

SEQ ID NO: 558 - DNA, 817 bp, Musa acuminata
  misc_feature (1)..(817): Ceres CLONE ID no. 1727213
  misc_feature: Encodes the peptide sequence at SEQ ID No. 516
aggctttcggactccgccgcttccgctcgaggcgaataaagacgatcgaacgggactcccttcgccgcctccaaatccaatccgcagtacaaatggctactgtccctgggccgctaatctgggagattgtgaagaaaaacaactcgttccttgtgaagcaattcggtaacagtactgcaatggtgcagttcagcaaagagccaaacaatctctacaatgtcaattcctacaagcactccgggttggcaaacaaaaagtcagtgaccatccagggtggagggaaggacctctccgttgttcttgcgacaactaagaccaagaagcagaacaagcctggtagtttacaccacagatcagccatgaagaaggagttccgtaagatggccaaagttgttataaaccaggtgactgataactactacaggccagatctgactcgagcagctctagcacggctcagtgcagtgcatcgcagcctgaaggtcgccaagtctggtgcaaagaagaggaacaggcaggctgtttaagtgggaaagtaggttgcgttgtttagtagtagttcgttggttgttttggttccgttcaccatgtcttcaaaccgattttgagaaccatttctttttgctgtttatttccaccagaggagccttcataatctagttttacttgatatgaatttagcatttggcgcttgatgactatattgctttcagtaatttgcttgattagaaacagtcgtgagatcttttattttggccagaaaacttgtggtctttcagtataacttcgactaaaggtaaagggtcggttgctcact

SEQ ID NO: 559 - DNA, 709 bp, 1767577
  misc_feature (1)..(709): Ceres CLONE ID no. 1767577
  misc_feature: Encodes the peptide sequence at SEQ ID No. 517
aaaaaaaaaaaactcgccgcgccgcgccgcagccatcccccaccagcaccccgagtcctggagagaagcagatcggcggcgcgtcactccaactaccggtaagcttaaatggcgacggttcctgattctctgatctgggagatcgtgaggaagaataactccttcctggtcaagcagtttggcaatggcaatgccaaggttcagttcagcaaggagcctaacaacctctacaatgtccactcctacaagcactctggccttgccaacaagaagaccgtgactgtgcaaccagccagtggcaaggagatagcggtggtcctctcgacaaccaagacaaagaagcagaacaagcctgccagcctcaaccacaagtctgtcatgcgcaaggaattccgcaagatggccaaggctgtcaagaaccaggtcggtgacaattactacaggcctgatcttaccaagccagctcttgcaaggctgagcgcagtgtaccgcagcctccaggttgccaaatctggtgtcaagaagaagaacaggcaggcgaactaagtcacaaggagttgttttgatgggtggtgtttatgtttcatggtttctagatctggagtatgatggatgatgtgcgtacctaagactgccacaaaatttcattgtaggttccacctttgtacccaactacccatgacatgattaagcatatgaatatcctttt

SEQ ID NO: 560 - DNA, 723 bp, Musa acuminata
  misc_feature (1)..(723): Ceres CLONE ID no. 1712104
  misc_feature: Encodes the peptide sequence at SEQ ID No. 518
attccgaactccgccgtctcacgccgcgctcagagaggccgacgggagtcttcaccgctgcctcaaacttgtctgtagaaatggctactgtccctggcccgctcatctgggagatcgtgaagaaaaacaatgcattccttgtgaagcaattcggcaacagcactgccatggtgcagttcagcaaggagcctaataatctctacaatgtcaattcctacaagcactctggattggcaaacaagaagtcgatgaccattcagcccagtgggaaggacctctcagttgttcttgcaacagccaagacaaagaagcagaacaaacctggtagcttatatcacagatcagtcatgaagaaggagttccgtaagatggcaaaagttgttaagaatcaggtgactgataactactacaggccagatctgactaaagcagctcttgcacggctcagcgtggttcatcgtagccttaaggttgccaaatctggtgccaagaagaggaacaggcaggcagttaaagcaagaaactagctgtccttcaattattttggtttggttcacggagtttttaactgaagagcttgtcaacctggatctcacaacttctttttgttattgttaatttcaccagaagaatttacacactctagttttaattagattgtgtgatgctattgctgctagtaggaatttccaattcaatgtgctactactgctcattcttgtg

SEQ ID NO: 561 - DNA, 748 bp, Panicum virgatum
  misc_feature (1)..(748): Ceres CLONE ID no. 1778377
  misc_feature: Encodes the peptide sequence at SEQ ID No. 519
gactcccgcagccgccacccccataccggaccggagctaggcgacgcagcggcacctcatctccggcgaagggaaatggcgaccgttccaggggatctgatctggcagattgtaaggaagaacaactccttcctggtgaagcagttcggcaatggcaatgccaaggtgcagttcaccaaggagcccaacaacctctacaacttgcactcctacaagcactctggtctggcaaacaagaagaccgtgacaatccagccggcagctggaaaggactccgctgtggtcctctcgacgaccaagaccaagaagcagaacatgcctgcgaagatcaaccacaagtctgtcatgcgcaaggagttccgcaagatggccaaggctgtgaagaaccaggttagcgacaactactacaggcctgacctgaccaagccggccctcgcaaggctgagctcagtgtaccgcagcctccaggttgccaagtctggcgtcaagaagaagaacaggcagccgaagcactaagctttgtgttttgttgaggggcctgttggtgctcgtagtcccagcttattatctatgttccaacagttttgagacttgaagtgagacttgttagaactagagcaaccatgttaaagctgctgctgtgtcgttccataatcacaaattgcttggcacttgatgattgctactttatctgcaaacttgctgcgcacgattacccccgttttcagaaaaaaaaaaaaaaaaaaaa

SEQ ID NO: 562 - DNA, 731 bp, Panicum virgatum
  misc_feature (1)..(731): Ceres CLONE ID no. 1787980
  misc_feature: Encodes the peptide sequence at SEQ ID No. 521
aaaaactcgccgcgccgcgccgcagccaccccccaccagcaccccgagtcctggagagaagcagatcggcggcgcgtcactccaactgccggtaagcttaaatggcgacggttcctgattctctgatctgggagatcgtgaggaagaataactccttcctggtcgagcagtttggcaatggcaatggcaatgccaaggttcagttcagcaaggagcctaacaacctctacaatgtccactcctacaagcactctggccttgccaacaagaagaccgtgactgtgcaaccagccagtggcaaggagatagcggtggtcctcttgacaaccaagacaaagaagcagaacaagcctgccagcctcaaccacaagtctgtcatgcgcaaggaattccgcaagatggccaaggctgtcaagaaccaggtcggtgacaattactacaggcctgatcttaccaagccagctcttgcaaggctgagcgcagtgtaccgcagcctccagattgccaagtctggtgtcaagaagaagaacaggcaggcgaactaagtcacaaggagttgttttgatgggtggtgtttatgtttcatggtttctagatctggactatgatggatgatgtgcgtacctaagactgccacaaattttcattgtaggttccacctttgtacccaactacccatgacatgattaagcatgtgaatatccttttagtaaaaaaaaaaaaaaaaaaaa

SEQ ID NO: 563 - DNA, 719 bp, Triticum aestivum
  misc_feature (1)..(719): Ceres CLONE ID no. 575833
  misc_feature: Encodes the peptide sequence at SEQ ID No. 524
tagaacatcctaaccgaaaataccgcagccgccacacacgacgaacaccggaacgaagcagatcggcggcgcgtcactccaatcaccggttcataaaatggcgacggtttcggattctctggtctgggagctcgtcaggaagaacaactgcttcctgatcaagcagttcggcaacagcaatgccaaggtccagttcagcaaggagcccaacaacctctacaatgtccactcctacaagtactctggcctggcaaacaagaagactgtgacagtgcagccagctgctgagaaggagatgactgtggtcctctccacaaccaagtcaaagaagcagaacaagcctgccgcgttcacccacaagactgtcatgcgcaaggagttccgcaagatggccaaggctgtcaagaaccaggtcagtgataactactataggcctgacttgaccaagcctgctcttgcaagactgagtgcagtttaccgcagcctccaggttgccaagtccggtgtcaagaagaagaacaggcagtaagcactgaggggccaatgagcttgttttgtggatccgttggtttatgtttccagctttttagatttgttctaaaagtatggaggttgaatatgatgaatggtgtgtgctgcatactggcacaagttttctcagtaggttctatatctgtacccatgactatgttgtgaagcctcttgaaatcatttccacg

SEQ ID NO: 564 - DNA, 935 bp, Gossypium hirsutum
  misc_feature (1)..(935): Ceres CLONE ID no. 1836904
  misc_feature: Encodes the peptide sequence at SEQ ID No. 525
aaaaagagaaaacataagctatcttttcaaagcaaaaaaaaaagaaaaagaaacaaaagcaaagagataattaagagaggaattcgaggaagaagaagggtttttttttttttcaaaaaaaattgctttttttctcttttgtgtgaagaagctggagctatcaaagatgatgcagattgagcagcaacaacagcagccccagcaacaacaaaaccagttaatggttcaaaactctgggagtttaagctttagcagtcacttgtctaaagaagatgaagagatctctaaatcagctctttctacttttagagctaaagaagaagagattgaaaggaagaagatggaagttagagaaaaagttcagcttcagttaggtcgtgttgaagaagaaactaaacgtctggctgtgattcgtgaggagcttgaagcacttgcagatcctatgaggaaggaagttgctcaggtgaggaagaagattgatgcagttaacaaagaattgaagccgttagggaacacttgccagaaaaaggaaagggagtacaaggaagcccttgatgcattcaatgaaaagaacaaggaaaaagtacaactaatcacaaagttaatggagctggtgagtgaaagcgaaaagttaaggatgaagaagctggaggagctgagtaagaacatagattccatacactgatcatataaggaaagagaagcccttttagctttggttttaactgattaggcttgtgtgtgatgtatttaaggtgactttgaatatttatatatgggtgtgttgtaatggtaatctttgtttgtttttagttagcattcrtgaatgctcaactgatttagaaaaagggaaataccctataaaaacaaaacaggtttgtaactaaaatgcactcttacatttctcatgttcaactattgtatctctttgtttt

SEQ ID NO: 565 - DNA, 980 bp, Gossypium hirsutum
  misc_feature (1)..(980): Ceres CLONE ID no. 1932013
  misc_feature: Encodes the peptide sequence at SEQ ID No. 526
ccttttttctctcactttctctctgttagtagaaaaataaactgcttggctgtttgctaagctttggtagagaaaccaaagtttagggggttaaccaacaagctaccattgtttataagcacttctcaacacgagaacaaaagaagagagagagagaaagagagaaacacaagctatcatttcaaaagcaaaagctaaagcaagaagataataaagagaggaattcaaggttgaaggagggtttctctttttctatttctttttctttttaaaatctgtgtggagaaactggagttagggaagatgatgcagactgagcagcagcctcagcaccaaaatcagttaacggttcaaaactctgggagtctcagctttagcagtcatttgtctaaggaagatgaggagatctcaaagtcggcgctttctactttcagagccaaagaagaggagattgaaaggaagaagatggaggttagagaaaaagttcagcttcagttaggccgtgttgaagaggaaacgaaacgtttggccacgattcgtgaggagcttgaagcactggcagatcctatgaggaaggaagttgctgtggtccgaaagaagattgatgcagttaacaaagaattgaagccactaggccacacctgccagaaaaaggaaagggaatacaaggaagccctggaggcgtttaacgagaagaacaaggaaaaagtacagctaatcacaaaattaatggagctggtgagcgaaagtgagaggttgaggatgaagaagctggaagagctgagtaagaacatagattccttgcactaataatataaagcccttaagttgtgttttaactcattaggcttgtgtgatgtatttaaggttacttccatatttataaatggattatgtttactgttttttcgggtttggtgtactgtatgatgtattttcgtttgtaatttcattagcatttgatgaaccttagctgattt

SEQ ID NO: 566 - DNA, 829 bp, 1767577
  misc_feature (1)..(829): Ceres CLONE ID no. 1768109
  misc_feature: Encodes the peptide sequence at SEQ ID No. 527
gagatgatacaccggccgcgccgaaccgccgagcgagagaaggtagctgctgcgtgcgcgaggaggaggacgagatgcagggcggcggcggcggcgtggagcagcagccgatgcagatggtgctgcgggtgaagcacccgacgtcgtcgtcgctgggcgacgaggaggaggcaggcgagggctcgtcgaggtcggcgctctcggtgttcaaggccaaggaggagcagattgcgaggcgcaagatggaggtccgggagaaggtgttcgcgcacctcgggcgcgtcgaggaggagtccaagcggctcgccttcatcaggcaggagctggaaggcatggcggatccgacgcggaaggaggtggagtcgatacggaagaggattgacacggtgaaccgtcagctcaagcctctcggcaagagctgcgtcaagaaggagaaggaatacaaggaggtcctggaggcgtacaacgagaagagcaaagagaaagcgctgctagtcaacaggctaatcgagctggtgagcgagagcgagaggatgcggatgaagaagcttgaggagctcaacaagacagtagactcactctactagacgccagctgatgctcacctccaccgagagctcgctcgccgcctccctgtaatctcagtgtgccataaggactcgggacttgttcaaggtgttgcttgtaactgatgtttctcattgagtgattcttccttcttctttctgttccttttgtttcttttctttcatcagctggtttgagtctcgttgtactgtcactgtcgagtaaaactgacgtatttaagcaaaaaaaaaaaaaaaaaaaa

SEQ ID NO: 567 - DNA, 717 bp, Gossypium hirsutum
  misc_feature (1)..(717): Ceres CLONE ID no. 1925996
  misc_feature: Encodes the peptide sequence at SEQ ID No. 529
attctcaaacccagttgaaagcctagagcttagtagcaacccttaggcttcttcttcttcttcttgttcttattattatttttactttctatctcataaaacctaaaaaaaaaaattaagctttttttgcagcttggaggatagaatagtggcgggtttttcaagcaaaataacaactggagttaagctctctcactgagaaaaaactgataagagtgaagaattggcaatcaacatggagaacggatatatcaacccggcaccaagtccacttaggaaaatcatcacggttgcatccattgctgccggcatccagtttgggtgggctctgcagctgtctctcctgacaccctacgtccagacccttggtgtaccccacgcttgggctgctttcatttggctttgcggtcccatttctggccttctggttcaacccatcgtgggatacaacagtgaccgttgcacctctcggttcggccgacgccgaccctttattgtcattggagctctctctgtctccatagctgtcttcctcatcggtttcgccaaagacattggccaccatgcgggagattccttgaagagaacgaccaaaccgagagctgtagccatctttgtcgtcgggttttggatcctcgacgtggctaacaacatgttgcaaggtccgtgtcgagctctcctcgcggacctctcggctaatgaccacaaaaagatgag

SEQ ID NO: 568 - DNA, 745 bp, Musa acuminata
  misc_feature (1)..(745): Ceres CLONE ID no. 1728680
  misc_feature: Encodes the peptide sequence at SEQ ID No. 530
gctctcgtcgctaccgcaatggcagcatcacatggttggctcacttctctgcccaaccaattggctgtcgcaagctctgtcgtcaaccatcgatccgctgcggctgcttcgttcgtcgtcagggcgagctcgacggatgcatcacttacggagaaggattgtttaaggagaaggcaggttttagttggactcagttccttgaccgctgctttgtcccgggcaaattttgcaagtgctgaagatataccggagaattttcgagctttcgtggattttacagatggatatgcatactattatccttccgattggagagattttgattacatgggccatgattcagcatttaaagatcgatttgcagcattgcaacatgtcagagtcagtttcattcctaccgaaaagaaagatattcgtgatttgggatccatggaggaggtcattttcaacttggtaaaaaatatttatgctgcaccaaatcagattccgagcatatatgagatgcaggagcgaactgtcgatggaaagaactattggacattcgaatacgaacttgaatccccaagcttttcccgtactgcctttgcgacaatagctattggcaatgggcggtactacacattagttgttggtgcaaatgagaggcggtggactagacttcggaacaagctcaaggtggtagcagactctttcaagattcttgacatatgaaactagaagtgcttgcctgccgaaccatgagtcc

SEQ ID NO: 569 - DNA, 842 bp, Gossypium hirsutum
  misc_feature (1)..(842): Ceres CLONE ID no. 1807796
  misc_feature: Encodes the peptide sequence at SEQ ID No. 531
atggcagtggcaatggcgatgaattcagtttcattgaactgggttccaccttcctttacaaagaaggcaaattatgtgacaaactccactgagctagccccaccttctgctttttcttcgcaaaactcactcacgtacaccaaagaaaccatttccaatgaagaaaacaattgcaagagaagactgttgctcttgggtgttggagttattacagctaatttactccctgcaaattcccttctagcagaagagataccacaaaactatcgagcttttgttgacattccagatgggtattcttattactacccatcagattggagggaatttgattttaggggacatgattcagcattcaaagacaggtttcttcaactgcaaaatgtaagggtgagattcataccaactgataagcaagacatccatgagttggggccaatagaagaggttgtttacaatttggtgaatcatgtttatgctgcaccaaatcaaatggtcaatatacttgatatgcaagagagaacaagtgatgggaaaaactattatacctttgaatatgaactcacctctccaaactatgctagtgcttcctttgcaacaatagctattggaaatgggagatattacacactggttgttggagcacttgaaagacggtggagaaggcttcgaaacaagctgaaagtggtggccgactccttcaaggtgcttgacatctgatgaccccccaacttatcttttcattgtatataaaccccgaaacataccattggttttgtttagttgagcgtcatcgtcaactttaactatttctccttcttcaaaaaaaaaaaaaaaaaaaa

SEQ ID NO: 570 - DNA, 883 bp, Panicum virgatum
  misc_feature (1)..(883): Ceres CLONE ID no. 1771837
  misc_feature: Encodes the peptide sequence at SEQ ID No. 532
ataactgatgctgggatacaagcgtcagagaacacttcctcgagctcagtgctatcctaaactactgaagaaatggcaagcctgcagaatctgatttgctccgtatctaaacaactggttgcgccaaattttgcggtgactgccaaactgaatggggcttctcactctgttgtcccagcaagctcaagcggagcatcttcgcatgaaaagaatgtcacgaaaaggcagttagctttgcttggtgctggagcattagccaccggcctactgaagacaagctccgcatttgctgaagaagtacctaagaattacaagtcttacgtggatgcaaaagatggatattcgtatctttatccagccgagtggagggatttcgacttcttgggtcatgattcagcattcaaagatcgtaatctggctcttcagtgtgtccgtgtggggtttattcctactgataaaacagatattcgcgacctaggaccaatggatgaggccatcttcaatttggtaaacaacgtttacgctgccccaaatcaaaaaccgtcgatctatgacatgcaagagcgcacggtggacggcaagaactactggacgttcgagtacgatctggaggctccgggctacggcgtatccgcgttcgcgacagtcgccattggaaacggtcggtactacacgctgatcgtgaccgcgaacgaacgccggtggagcaggctccggaacaggctcaaagtcgtcgcggactctttcaagatctccgacctgaccgcgtgaccgccagcgttctcgttaactgtaatggacggtctcattcagtcatggtatatatacttacgcgcgccataatcgtgcgtgtttcatttgctaaaaaaaaaaaaaaaaaaaa

SEQ ID NO: 571 - DNA, 973 bp, 1767577
  misc_feature (1)..(973): Ceres CLONE ID no. 1773482
  misc_feature: Encodes the peptide sequence at SEQ ID No. 533
cacgagctcagtgctaccctgaactactgaaggtgatatggcaagcctgcagaatctgatttgctccgtatccaaacaattggttgcgccaaattttgcggtgactgccaaactgaatggggcttctcactctgttgtctcagcaagctcaaggggagcatcctcgcatgaaaagaatgtcacgaaaaggcagttagctttgcttggtgctggagcattagccaccggcctactgaagacaacctctgcatttgctgaagaagtaccgaagaattacaagtcttacgtggatgcaaaagatggatattcgtatctttatccagccgaatggagggatttcgacttcttgggtcatgattccgcattcaaagatcgtaatctggctcttcagtgtgtccgtgtggggtttattcctactgataaaacagatgttcgtgacctagggccaatggatgaggccatcttcaatttggtaaacaacgtttacgctgccccaaatcaaataccgtcgatctatgagatgcaagagcgcacggtggatggcaagaactactggacgttcgagtacgatctggaggctccgggctacggtgtatccgcgttcgcgacagtcgccattggaaacggtcggtactacacgctgatcgtgaccgcgaacgaacgacggtggagcaggctccggaacaggctcaaagtcgtcgcggactctttcaagatctccgacctgactgcgtgaccgccagcgttcgtttaactgtagtgtacgctctcattcagtcatggtatacttacgcgcgccataatcgtgcgtgtttcatttggtgaaatgtaaaacgtcaaatattgatttgctaccgttttgtggcgtccaaaattgtatgttcggtgaaacagcacccaatcagggcaggtgcagggctatgccagcggtaaaacaccgaaacgaatcgacgaaaaaaaaaaaaaaaaaaaa

SEQ ID NO: 572 - DNA, 1710 bp, Gossypium hirsutum
  misc_feature (1)..(1710): Ceres CLONE ID no. 1920025
  misc_feature: Encodes the peptide sequence at SEQ ID No. 534
aatcccaaaaatccaaattcagatgtcattttcccaaactcttttcttcaaaattaaaccccaagatcgattttgaaaacccaccaaaacatttgcacttcaataaaaaaatttcaatacagctctttttttttttttgtatggtagtgacaccagaaaaaaaactatcaaatgcaagaatccaatgcgccatcatcttcttaaagatagaaatctaataaccttcttcgatccttaaaatcgatattgttttttgttgttttggatctgattttgaagcgtttaaaaatttcaaaaacaaaatggggagtttgggagcactgatgaaacatccagatgatttttatccattgttgaaattgaaaatggcggcgagaaatgccgagaaacagatcccatcggagcctcactggggtttttgtttctctatgcttcacaaagtttctcgtagtttcgctcttgttattcagcagctcgatacagagcttaggcatgcagtttgcatattttatttggttcttcgagctcttgatactgttgaggatgatactagtgttgcagcagatgtcaaagttccaattcttatagatttttatcgtcacatatatgatcccgactggcacttttcttgtggtacaaaggaatacaaagttctcatggatcagtttcatcacgtgtctgctgcttttctggaactcgaaaaaggttatcaggaggcaattgaggatattacactaagaatgggagcagggatggcaaaatttatttgcaaggaggtcgaaacagttgatgactatgatgaatattgtcactatgtagccggacttgtcggattaggtttgtccaagctattccatgcctatggatcagaagatttggctccggaatcgctctccaattcaatggggttgtttcttcagaaaacaaatattatccgagattatctagaggatatcaatgaaataccgaagtcacgcatgttttggccacgccagatttggagtaaatacgtcaagaaacttgaggacttgaaagacgaggaaaactcggtcaaggcggtgcagtgcttgaatgacatggtcactaacgctttactacatgttgatgattgcctgaaatacatgtccgctttacgtgaccctgcaattttccgattttgtgcaatccctcagatcatggctatcggaacactagccttgtgttacaacaacatcaaagtcttccgaggtgttgtgaaaatgaggcgcggtttaactgcgaaagtcattgatcgaacaaaatcaatgactgatgtctatggtgctttttatgatttttcttgcattttgaaagccaaggtcgacaaaaatgatcctaatgcacaaaaaaccgtgagccgactcgattcaatcctgaagacttgccgagactcgggtgtgctaaacaaaaggaaatcatacataatcgagaatcagtccaattacmctccgtttgtggttgttttgcttttcatcatattcsccatytttttggttaacctgaacccaaactggcctaataactagtaagttcgatttttaaataatgatgggatagaattatgttgcttggattgaagggtcagggggatttgatcagattttttttgaatattttcgggtaattaaagaatatttggatgtttttttttcatattaatgtcccagatgcaagttttgaacgtgggtactt

SEQ ID NO: 573 - DNA, 1773 bp, Panicum virgatum
  misc_feature (1)..(1773): Ceres CLONE ID no. 1749989
  misc_feature: Encodes the peptide sequence at SEQ ID No. 541
acccttctcagttctcatctcaagttctcaactcgtctcgtctcttccctggtaggggagaggaggcgctactagaagtactaccacgcggctgggcgcgccgcatcgagtcggcatctctctgggatccggctgcccggtcgtccggtcgttggctggatcggcggcgatgggggcgctgtcgcggccggaggaggtggtggcgctggtcaagctgcgggtggcggcggggcagatcaagcgccagatcccgcccgaggagcactggggcttcgcctactccatgctccagaaggtctcccgaagcttcgcgctcgtcatccagcagctcggccccgatctccgcaatgccgtgtgcatcttctacctcgtactccgtgccctggacaccgttgaggatgacactagcatcccaaccgaggtgaaggtgcccatcctccaggaattttatcgccacatctacaaccgcgactggcactactcatgtggaacaaataactacaaagtgctgatggataagtttcaccatgtatccaccgccttcctggagcttggtgaaggttatcaaaaggcaattgaagaaatcactaggcgaatgggagcaggaatggcaaaatttatatgcaaggaggttgaaactgttggtgactatgaagaatactgtcactatgtagccgggctggttgggtatggactttccagactcttttatgctgctgggactgaagatctggctccagactcgctgtcaaattcaatgggtctatttttgcagaaaactaatataattagggactatttggaagacataaatgagataccaaagtcccgcatgttctggcctcgagagatatggagtaaatatgcgaataaacttgaggatttcaaatatgaggaaaattcagaaaaggcagtacagtgcttgaacgatctagtgactaatgcattgattcacgctgaagactgcctccagtacatgtcagccttgaaggatcatgccattttccgtttttgtgcaatacctcagataatggcaattggaacatgtgctctttgctacaataatgtgaatgtctttagaggagttgtaaagatgagacgtgggctcacggcacgagtgattgatgagacaaactcaatgtcagacgtctatactgctttctatgagttttcttcattgctggagtcaaagattgacgacaatgatccaaatgctacgctaacacgaaaacgcgtggattcaataaagcaaacttgcaggtcatcaggtttcctaaagagcagggggtaccatttggacaagtcaccttacaagcctattctgctcatgattgttcttctgctggtggctattatatttggggtactttatactaagtgaagccctgctagttagcctttttcttcatgtggagacttaagagagcaactacgccaatatgattttgttttgtactctgtagtctacgaaggctgagaaaaaaatccagaagtagggagggactgtagatggaatgatggatatggctgcatgctactgcttcctcatttcttttgttccttttctttcctcgcgtgttgcaccgtttgaagctgtttctagggaaaagaaacttgcaacatgtatcctgtaaacttatgttagcagtgggcacactagtttgctgacatttttttcctttcgaaaaacccgtataagagtattgtttttccggaatcgtgtagtggaagaacatcaaccgtgttgagcagtaaaaaaaaaaaaaaaaaaaa

SEQ ID NO: 574 - DNA, 1683 bp, Triticum aestivum
  misc_feature (1)..(1683): Ceres CLONE ID no. 706088
  misc_feature: Encodes the peptide sequence at SEQ ID No. 544
gacaaccgcaccgcaccgcgcccacacacgccacgcagcgcctcggtaccatcgcgttcctgctcgtagcttcgtgtcccgtcccacccccggcggcccgcaggatccgtccggctgcggtgatttgatttgatttgtgatttcggttcgtgcggcggcgatggggatgctgtcgcggccggaggaggtgccggcgctgctcaggctcaagctggcggcggggcggatcaggcgccagatcccgccgcaggagcactgggccttcgcctacgacatgctgcagcgggtctcccgcagcttcgcgctcctcatccagcagctaggccccgagctccgcaatgccgtctgcgtcttctacctcgtgctccgggccctggacaccgtcgaggacgacaccgccatccctaacgaggtcaagctgcccatccttcgggacttctaccgccacatctacaacccggactggctcttttcatgtggagcaaacgactacagagtgctcatggataattttaggcaagtctccacggctttcctggagctaggcgaaggataccaaaaggctattgaagaaatcactaggcgaatgggagaaggaatggctaaatttatatgcacggaggttgaaaccattgatgactatgatgagtactgccactatgtagcagggctagtaggctatggactttctaggctctttcatgctactggcacagaagatctggctccggatcatctttcaaattcaatgggtttatttctacagaaaaccaatataataagggattatttggaggacataaatgagataccaaggtgccgtatgttctggcctcgggaaatatggagtaaatatgtcgataaacttgaggatttaaaatatgaggaaaattcagaaaaggccgtgcagtgcttgaatgatatggtgaccaatgctttgatccatgcccaagattgccttcaatacatgtcagcattgaaggacaactccaattttcgattttgtgcaatacctcagataatggcaattgggacatgtgctatttgctacaataatgtgaaagtctttagaggagttgttaagatgaggcgtgggctcactgcacgggtgattgatgagacaaaatcgatatctgatgtctattctgctttctatgagttctcttcattgctagagtcgaagattgatgataacgacccaaatgctgcgctgacacggaggcgtgtggatgcaataaagaaaacttgcaagtcatccggcctgctgaagagaaggggttacgatctggagaaatcaaagtacagaatgcctatgctgatcatgatcatgcttctgttggtggctattatcttgggtgtactgtatggcaagtgatccggtcaagatggtcctcttatgttcttagtggcaccgcctcccctatgtggttttgcacgtgtacttcctgactgcagatggatggctggtttgcatgtagtattgtgctatgtaccctgctggtgccatgcatgctagttctttttgttctttgtttctgtcgtcccgtatgttgtttcagcttgtaatttgtttgaatctaggagagacttccttagtgacatgtatcctatgaatttggcgtggcgccttggttgtcaatgattctacattttgtttatttgtgactaaaaaaaaaaaaaaaa

SEQ ID NO: 575 - DNA, 1229 bp, Gossypium hirsutum
  misc_feature (1)..(1229): Ceres CLONE ID no. 1839717
  misc_feature: Encodes the peptide sequence at SEQ ID No. 545
atttcttccactcttcctcactttctttaagccttcaccagtgtttaggtttaaaatttgcagattttgaactaaaaggattttgattgttccttaaagttttcaccttgtttagatgtaaacaaactgacatgtttttggcaataaaggtccagtctttttagtcccacaaagaagattgctgttctttttaatgttttgttgaagaaaagtaggaaaaaaaaaaggacaaagaaaaagaaaagagctggctttcggactttggggtgttgatagtttggttgaagaaagtgaaaacactgaagcagaaagctttttactttggggaatttttcccttgttgaatttgggtattgaaagttttcaagttatagtacaaggcttgagatttttgcttttagctctttggccaatgcaaactttatgttcttgtgaaaacgggatagaggtcagaacgatgatggaaaacaaaaggagcccttgctctgttgatcatagcagtttcactcctttggcgtcgaagcgacagaagtccgacttattgatctcgacaaaggataggaaagataaggtcggtgaacgcattgtcactctgcagcagctagtttcgccatacgggaagacagatacagcttctgtcctcctgcaggcaatggagtacatacagtttcttcatgaacaagttaaggttttgagtgctccgtatcttcaaacctcaccgacaaataatatgcaggagcaagagcattatagccttagaagccaaggtttatgtcttgttccactctcgtataccatgggagttgttcatagcaatggtgctgatatttgggctcccatcaagaccgcttcaccaaaatttgacaagcctttcacacaattcaattgacatattttccttcatcggtgaccggtaggctttgaacgtttcactggaaccggttttaaaggtaaccaacttaaatcttgaatgcacaaaattttcctaatcagatgcaaaatttatagcacaaggcactgagataggatgttagtatcgagaaactagtaggattgtgtatccagaaatgcagtcctgtgcctacttagttttaagccagtgatctgcatttaatcttatattgaatttatagaaattaattgatctctccttaatcatgtattgtaaaatgtaaattgatgaacatgagttgattaaccacttttaacaaaaaaaaaaaaaaaaaaaa

SEQ ID NO: 576 - DNA, 1836 bp, Oryza sativa
  misc_feature (1)..(1836): Ceres Promoter p530c10
gcctctcgaccacgagtttagcacttgtgcaacatatatgcgtgcgatgaacatctactgatgcgccatgcgaattttagcgttcgttcatgacgcttccaacggcacagaggctgagcagcagcatgcatgcatggctcttgtgaaaacaaaaaaggttactggtaaatgacatgctgctgtagctagctagcagaatgcaaggcccatgcatatgcaatgctatgcgacaagtacagtaccagcatgtatggtagccagctaactaatctatcagcagaggcagcaagctcgtgcatggtgtgatgcacttctctccagtaatctagtggtaattttcacccaaagcgttgctcatatggacagtaattagtaatattaccaaggttcacaatcccgttacctgaccaaatactactcacgaatggtatctctggttttcgttaaaaccgttggtaaaccagcaaaaatagacaaaatttgtcaaaattttaaattttagttttttttttttaacttagccgggaaaccttgaagtttgtgctgtcgagctgtcctgggaaggacggttttggttgggattgtgaaccctggttactgcacttcatttttgaacagatattagtgcaacagacaaatgccaacgcatttttttctgtttaccggcaagctgaagcttttacgatccccatacagccgttgctgcaaacctgccaagaaagagcagcagaaacaggtgtcattttgtggtggaaagccaagtaaagtaaacagaagatggaagatagtgaggaccagggagtgaggcaggggacacatggcccacgcctccctgcacattttcgtgtataaatacaggtggatgcatcgctctcccagcatccatcggttctctgctctgttcatccatagagtttcctcctcttctcctttagtgcaaggtagagaagagcatgtgtgtgtgtgtgtgtgtgtgaactgtgaagtgcagagtgcttctgtagttctgtgttatgtccatagtgatcttgttaggattgttgctatggatgcatgatgttatggttgatctctgaattacagtagggacttttctgagatctctggattagtggggggtgctaaatttttttctggttgcatcagcttgggtttctggtattggtgtgggttcttgctctgaattttggttcagaatgtcgatttgtttgtgtttgttctctgaagttgagagtagctatgatccatccagcacagaactgcaggtcctgcctgccggctgcatatacaggacatgccattttgcaagctctgggcttatggtttctcttttggagttcttcttcttgcatgatctgtgttctctaacaaaggaagcaagatttagcaactttattcagagacaagaaaaggatctggcaaccttttgtttctgttttatcctactcgtaaagattgttatttaagcaaaaatttcccaaaagttttaaatataatttccatgatgtgccactctcatgtccttgaacctggcactcattatgggctcctcagaagtgctgtagctaatgtcactaatcttttgtatctttgttcatagtcttgtattttatgatgcttatccctttgtgctttccatgtttgatgtccaaatgtcatggcaatgtttttgacttctagtaggggttttagtacctttttgttagataagtacatccaaattctgtttatttattcaaaaatcattctgtttattcactgaaaacatttgtccattcaatggactcataaactgtctgtgtttttcaggcttgaggatccatctagaagatagca

SEQ ID NO: 577 - DNA, 3000 bp, Oryza sativa
  misc_feature (1)..(3000): Ceres Promoter pOsFIE2-2
gcttaacacatgaactaccaaaatatactgatcactttgttctagtcatacataccttaagtcattttattctgcagtgtttggattggagggagcattctagcatcccttgggtcgttccagcaaatgtggttctccaaagcagagtaagcacaacacagtattttaggttatgtttcccctatctcgtcacggacagctcacaagttaatgtgatttatctcactatagatacgaagaacatggagtatcctacatccaaaggaagtgcccatgaagttgtggagcatcgctacgatttgtgaccaaatttgggtgcatgtgggcaatcgtattacagccaccctgttgttgatctatatcgactattatccgacgatatttatcattatattatgactagttagtttgtagattttgagagggcaacataagaagcaatccagcttaacctgttatgttcttgatggtagattctagttcatgtgttgaatctgttctccctgctgtagaatgtatcgagttgctgctctctactctgtacttttagaataccttttcaatcatttggagtcagctgattgttgtactacttatacgccacctgattagtcatgtcaacaattaaacttgagcactggttaagttaagagtggcctgattgtagttgataatcacattttattcgtagacattgtatgctggatctttatcagccaccgtcagatcatcctctgtaataaatcttcatcagacgtgtgtgccaatcgcaaggaacacgaaatgcatccgaaatgttactctgagttaatcaatactataattcttggtcaaattaattatttatatctataaagtttaaattaaatttaggaaaatgaattcatgcaaatcttgtggtaagttgtcaatttcataaaaaatccagcttactactccctttttaggagtgtgttgtggctgcacacttctgccttttgatatatacggttctattctcggtgtactcctttattattattaaaacaatcccagttacttggtaagtgctaatcacgaatcaaagtcaacataacaaatcatgtgcgtacagctataactcgattacacaaacaacaaaattcatatttgaacataaatccagttgtagcatatctggtagtataaagttttttttttgtatagaagagttttaatttctgtaagttttggaaagcatttaatcctagaaattgtagtgtagctcaactaaaaaataaatgaacttgaatcgaaattgggttgtatcataaatctttaccactcaaacgaatatttatcctaaaccacaaatgactcttttcatcaaggaatgttttgttttcagcattttaaaaaaaaacttttctaatatggttttcatgtttcgttcttttgaaatttaacatctatttaatttgcacggctccataaattcaacggatacatattctgaataattactaaggaggcatatatcggctctcttaatacaaccgcttgtttctcaaaatttattttgagttttgtctacacattctcaaggacggtacaaacacactatagatgttcacaattttttttttctaaagttgattgatggacaaatgtttgaacatataaacatataagcactgaatatttgcttatgcaggaggtatttatatcaagttcgatactttactaccatagtccctaggacactaaaatgccttcaatgatctgatgaagcctaagagagaatattgatcagtggagcgacttgcaactacacatggcacaagtagactagacacggtatatattcatattaacttgttaaaattttactacttaacagttcacttgtggtgcatccatatcaattcttacttacacaatatttgtaaaaacaacctaacactataggatgacctagacaacctttatgtcaatcacacttagaagatgatcgtctttttaataaataatgtgtactacacaccatgctctccatatagatcaagatctacaaacccttccacttataaaccttaccaccaaaaactcattaagttgcttcatttatctatgctattaagaaaaaaacttatttcgtttatgccatttctagaaatggctagtcacactattcacaatattatataataaataaaagtttcaaatattcatccaccaaaaatcatcaagtcgtgggacttatatgttaattagagaagtccctttgggtgcaatcgattttggaaaccctaaattttttctatacatagaagagagagatgtctagttgcaattgcttttgcgatgtgccaaccacccttctagctttcatccacgtctacttaattgccattcttcttcttctttttcttcactattactacctcctatcttagcgaatcttcttcttcttcactattactacctcccaccttagtgaattcatcctcattgttcacaatgacattgctaagttaactaggtatgctaagtacacaattagaatataacctagagcctttgtttccatcatacttaaaagatgacatttttatatagataaagtgtgctactcacaaggcttactatatatatgtatgatacacacaaactccacaacccaaaactctttcaagttgtgtggcccatctatgctattaaaaagcccatttagcccatccaacatgagaaaccctagggttttttccctataaaagatacctaggttattgttgcttttccaccccgcccgccgccgctccctattcctatttaatcccatctctcttcctcatcaccgctctcctctctccaggcaagaggtacgcactttttgtttcggatttgaaatctttgcttcgttttactatcattggtcataagttcttttttgaagatgtttgagaataagtttatcattgagattatcgtcacttgtgataggaagtacgcaacctcaagccggacaagacgtgagcaaag

SEQ ID NO: 578 - DNA, 2023 bp, Oryza sativa
  misc_feature (1)..(2023): Ceres Promoter pOsMEA
gagagcagaacatagtagccgctgttttctgggggtgcaatttgtgcaagatcgctatccttatggaccatgcaagcaccaagcaatattaagccaggtccaacagcggtcttggggaattcagaaatgagcttaaaaacctccttgagctggccagctcagccaaggaggtccatcatgcatgtgcatgctcaatacttggaattattgcaaaatgatcggtcattgactggaagactttgcgcccttcctcagccaaccttatgtggctgcatgcatagagtaccaacaggaaggtagcgtttgttggaataaggtttgcatccagcatgtccttgtagagcttcaaagcctcagcaccttggcccatgaaggccatatccagctaattgcattccatgagaccacattcttgctatccatactgttgaagtgaagatgctccgagcttcggaaatgcttccacactatgcatacatgtcaatgagcactgtcatgacataaacattgggccccaagtcctcctcagcgataatcctatgcagccactttcccagggacaaagctccaagctgtgcacacgctgaaagagagctagaaatgatgattggatttggtcacacgctaagtaccagcatttgctcaaagagggcaattgccatctccgtccagccattctaggcataccctggtattattgctttccatgattccgattccgtggtcttctatggcatcgcattgaaggccttccttgcagactccatatcatttaacctacagtacaatatggtaattgctgtcgacactggagaattcgcagtaaatccagacttgagaggaccatgtaagcattgatcaagcagttcattcccaaacagactatacgggatcagtgccagtgctcgagtttggcttcaattccaaggccatcaacccaataaacagattaactgatgaaccaaccatgcaattcgccgagcaaacatagattaagcattgtaggcaaccaaatctggattctccatcaagtcaaagagacgccatgcagaattccacatccccgctgtatacaccgagatcaaccggtcagaacatgctcatactccgccaaccctctcttcagaacatgctcatactccgccaaccctctcttctctgcaagaggcatcctccccaattccccattgttatatctgttgctggtaagaccgttgccagcgtggttgtgtcagaccgaacagactctgcactcgccatcctcacgaacgactccagggcctccgaaccaggaagcccggccggccatcagcgtgttccacataacggtatccggcgactgcacagtgtcgaacaccttgcgtgcgtggtcacctctggacagcatgaagcgtacaggctacagcttggccaatgcggacgccacgaacgtgtcggcggcgtaacccgcgcgtgcagcgcgccgcgcgcgggctgcggagtcggttggagacgacacgccgccgccatgagagcaatgagcgaggtggcggcgaaggcgaaggagaagtagtcgaggcaagcggaagagaaggcggcagcggagaaagcgatcggggcggcggaggaggtgggtgggagggagggacgcgtagcggaggtcggaggaggagggagctgaggtttccggggcgggggtcgagagggtagtgtacggaggcgagggacacggcgaggatctggtcgaggtagcgcagtgtgaaggaaagcgcgatgaggcggagggcgccggcgaagagcggcgcggcggatagcgggaggaggcggcgccggcggggtctcatccgattggaaacagattgggaagggggagggggtaggaatacgtggcgtcggcagtattaggtagagagagaaaccctttccatcctttgtctcttagccccgaaggagagagaaaaatcagaaaaaaaaaaccctccgcgtgtgggggaagcagagctccggacgctggcgccgctcgcgccaccgcacccgcaccgcc

SEQ ID NO: 579 - DNA, 2034 bp, Oryza sativa
  misc_feature (1)..(2034): Ceres Promoter pOsYp102
gaacgacccaaacgcgtaaatggtggtactggtttccctgctttgccgagtaccagcagccacgaagaacgttacacaatcgagtacaaaatctataagagcaagtttaatagcatagccaaatactacctctaaatcatctatagccaatttaatagttcatttattcaataattacttataaacatatactacaatcattaatatatggtcttacttcttatacacataatattttggagtccgtgttacagctggctataaatataagggattttggttggatgtggtacatcctattataatgaatctagacatgaaacctgtccaaattcatcgtgctaggatacgccacatctaaccaaaatctcttatctttagggatggagagagtaataattaaatgaagctaggtagagtttcccggtcaatacgcttgcgtgtgcttataagagcatggccaacagtttcccgatactcttcccaatatcagttttgaggagttttgttggaaaaaatcgctccaacagtagacctaaatcacccctaaaagcttggcgtttccaaacccgcatatttcgttctccacttgtagggaagagactcggcgcccaatccttcaaccgcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtcgctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgcgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctctaagttgcacatcctggggaaaaacctccctaatccatcagcaaaccgatcaaccacccacgacaagtcgacgccaccgttttttttttctccctcctaagtcctaaccccacaaaaatcccgcgaactttcgtctcaccacgcgccgcgtgccccctacaaataccaaacaacacccaccacgtccactcacaaaccacgcaggaaacctcagaaaatcaccgtacgcgacgcgggcccaagaaaaccccgacagaaaccgcgcagcagcaacaccaccaccggcgtcggag

SEQ ID NO: 580 - DNA, 1877 bp, Oryza sativa
  misc_feature (1)..(1877): Ceres Promoter pOsYp285
ggcccgagttaaacgatcttccacgtgtcagcgaatcctagtcgttcgatgaatctgaatctgacttgtggtggttggacggccacgtgttaaaaaagggaaacgtccgcatcacccgatgctgggacatttgcaatttcgatccagctgtagattgaccagttgttactctcttttttttaacaccatacaaacgtaatactccctctgtcccaaaatataagtattttttttaacctcggttcagtcttcgaggtgctactttgaccaataatatttataaaaataagatgttttaaataaagagagttgcatattatgatagctcgtttaatgataaacaaagtaccatcaaatttacatgattaatctttttaatttatttgctattaatagttaaaatttaaaaagtttgacttcacactgttctaaaaatacttatattttgggacggagggagtacacattagagcaggtacaatagcagactagtagccagctataaacatattttaatgagataaaagatgagagagaacagcgggctacagatctgtagccagctgcagcacggactccaagacattgtgtgtgtatgacaggtgggaccatatattaatagtacagtaagtaactattgtatgaattggctattagattagctataggtgaattgtagctagtagtgggctatactattgaacttactcttatatctctcaatatctccagaaaactaggacgatatatattgatattaacaaagtcatcatagatatctcgctatcgacatatatattacctatcactgaaaaaataattaatcataaatgcaagcacatatactacgttcaacactgaatgtaggtagattggtagacgggttccaccgcaagaaaagcattgcaccagtgaagaaagaaacatcggaatttgtatgtagtttgttgtttgatgaattcttttgattaaaaaaaactaaaatcagagttgattcagttaatggtgttgcctacgatatacttccatatcatgatatcactgtagactatgaatcatatctttaattaaaactaaatcaagaaattaagtatgagacctcaactcaatgaagaatttctagttgaaaaacattcctagtgtgcgttcggatggaggtagggatcttctctccgttcatataaaaccggatggttcattagaacatgattaattaagcaacagttaatctaaaaataaattaatattttttaagaaatttttgtatagagatcttttgaaaaaaatacattggttagaaagcatactaataaaaagagaaaaataagaacatagtactatagtagaaaatgagaacttggagtatttgagaggatgggaaataagaagattaagaagatgcgtaaagtgaacggttaacgcatgattgattaattaaatattaattattttaaatttggaaaataaattagtatgatttttaagcaacatatatatatatatatatatatatatagaaaaacatagttttagaaaatataagcgtgtaaaacgatatgcaggaacgaaacgttgagcattcaaaatttcaaattgaacatatgaatcaagagagaataaaaaaagaggccttctaggctggcatggacaattggacatgttttcaactagggtttcaagcttcgagcatccacttttgtccttgcaaactttatacggcaaggcccgtgaatctagccccccacaccaccccacccgcccgcgccgcgcggccgcctcgcctcccctcccttctcctcctctccgcccccgccgccaggccgtccacctccgccgtctcctcccccattcgcacccaaggcgctggcgcggaaggc

SEQ ID NO: 581 - DNA, 1000 bp, Arabidopsis thaliana
  misc_feature (1)..(1000): Ceres Promoter PT0565
caccaaatatagtgttatttcaatactaaaatggtgttatggttggagatgccctaaagataaacatgacgagacacgagatttattaatttcttgatcaaccataacttaataacttaatattaatttcacttaataatttccaattaagtgaatctttacttcaccaaaagttcctaacgaactcttattttctagcatcaatattaccatgaactagcatcaatactatcatgaaaaattcctacttcctatccaactcttaataacaatgctagtcttaacaatattcatcaaaaacttgatatagaccttctaacttagccacgactagtatcggtgaataccaaaattaatgtattcatgagaacttgagatttctctaatgtattcttgttactaaacaagtaacaacactcaagaaatatcatgatcaaatattttactcataaactccatatttcacattttgaaaattttaaacagcaaatcacattgaattttcgtggtaaaagtatttaaaattgaaaaatagcagctcctgatttcaatgtataaatttatctttatatggtttatgtctccaacttattttaaaaaagagagaaagagcacccaaaaggtgaccgtttgaaattcgaatttatttccgtttgaaattcgaattcaaaaaaagtaaaccgaaccgagtctcgttactgactgtcacacattgtttccctaaaagctaattaacccatacgtggcgtaatataacaggtcagtgatcaatactaaataacagacatacacctttaaaattcgtgcacgctccaaaacaaaatctacacttcaaaatcaacggtcacgatcattcctcaaatttcaaaaaattatttaacctcacttccttcgctttgtttttaaaacctctctctctttctctttctctttcgccattaaaactctgtttcctttttcagagattctcagagaagattcattttaccctaagaaaaaa

SEQ ID NO: 582 - DNA, 999 bp, Arabidopsis thaliana
  misc_feature (1)..(1000): Ceres Promoter YP0015
ttgagccttattgttgttattgacttttagccaatagaaagagatggaaattcaataattatccacaaaattccaaatcattggtgtacaaaaagatctaaggctgttatattttcaaaaaagaaagaaaagaaatgcaacaaatatggattaaactgtggtttgtaaattgagctttgcatgaaaactttatcactatgatttcactactccatatttattgactaaagtggcactaatgaatttcttaatcatgaaatcttgtatcaaaaagtactaaaataaacatgacattggcaattaggaaaattctaaattagaaattagtaaaaatgaaaggtgaaagggaaagatgatgatatgaattggttggtgaccaggagaaatgtatcccgatttttgcagacactttcagtgtccccattcatataattatggcccacctcgttaagatttttcattcaccaccataacaagatctaagcttagatttcatgtaattaaacatataatatacttgccaatactatctaataaagtatacttaagcaaaaattattactctagtgtaaggcgatgaaatataagtttagttgaaaatttatgtcgatataacaaagtataatgaattaagaccttggttttcgattaacaaactaattaaacactagttttgcctaataaaaccgggaatcgtattcaaaaccgaacgacaaaacaagggacaagttgagagacaaaaccaaatcagcatctttcttccagaaatgtcatgaccacatgacgtcatcttgacccttcttcattgtgatatctgtggataaagcgcacgtgtttaattcacgaaccttcgtagtaacgaaaaatccacaactttcatattttttaattacccactaaactaaaacaaatttggaaaaacatgaaaaactttttctttttttccaggttcgtgaacctcgtaccctctatataaacctcttaaccaccttccacata

SEQ ID NO: 583 - DNA, 999 bp, Arabidopsis thaliana
  misc_feature (1)..(1000): Ceres Promoter YP0087
tgaattgagtaaaatgtgttttcaaacagttaggtggtagaaggtaaaggtaataacatcatgatcttactaaaagaattgttgcatactaactatcaatattctcaacaacataatataatgtttttttaggtaattttccattttaattttttgtgattaaacaattaaacaactcgaatgatgatgataaaaaaaaaaaattaacaactcgaataagttaaagtagcaatacacatgtcgttcaattcaaccaataaagtaagacttatatttttaagaagttgactaatagcttaataagttggaaaacttgtgtagtttcttaattcccacgtgcagtaagaaataaaaatgaaaaaaattattatatccttcccactctgcgacttttcttttattttatcaaatattaaaaagattcatatcacagtttacacattgaaatcataaacgataattatgtattttgtaataaaaagttagttctgaagctcatactttggatagtcgctagtcgctaatatgctccttgtaataattaaagtcactacgacgcacgtcaaagccgatatttagggcttaattgatgcgtgtttttcttttcatataatagtaatataaattagtactaataaagtatgatggatggttgagacagaaaagaaaaaagatgactgtatggtcatcattacaaagaagaatgtattcttcatgttcttaagaataataaaatgtcacttgtaaatcaagttggtaagcattttgagaactttgttcgatgcaacgtatgatgatttatgtagacaaaagataaaaccgtatcttcaactattgccaagaaaagataaaacctaatctagtcagtctctcaacataaatacaacccaatagccaaactgtgtccaattcggagagaaactaaactaaaacaaaacacaaaagcccaacataagcccaataaaacccattttataaacagaacattactaacactca

SEQ ID NO: 584 - DNA, 1000 bp, Arabidopsis thaliana
  misc_feature (1)..(1000): Ceres Promoter YP0093
atgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttactaattttcacaga

SEQ ID NO: 585 - DNA, 999 bp, Arabidopsis thaliana
  misc_feature (1)..(1000): Ceres Promoter YP0108
ttagctgaaccaggaaattgatctcttataccagtttccgggtttagattggtttgatggcgatttgattaaacccccgaaattttatgtcgtagttgtgcatagtattattattctttgcggacaatagacgtatcgggaccaagttctgtagcaaaattgtataagcttaagtttgatgaaatttaaaggtaatcactaaaacccaaatgggacaataaaccggtgaagatttagagtttttaattttgactcatgaatctggagaaagagccctcgttaaaaggagtgaatcaatccataggggaaaaagttttgtctttttaaaaactaaagaaccaaaccttaatagaagcagctcaatgtgtgacaactttccactggcactaagataaagtgactagcgatgagtgcaattattgaaatagtagatggtaaatattacatacaagagtaaaaatatctttatgtcaatgcttaattcagtgtttctggttaacaagagaaacttctctaactttcgtaattgggtcttataaaattttatgcaattatgattttacccttttactacttttcattagctttcacgaatctattttgacaagagaaatcattagaggtaaacatgctttttggtcaagggccttaacagttccaccaatcaagctcaaaagttgtacttaaccgacatcttctgtgaaaacatataattacatgtacaaatcaaaactaccttatgaaataaatagaaatattgcagttcatttctaatttaacctcttcaacttttaaaactatttacatttctttatgtcatttctagtcattttgatgcaaattgtaccatttatggattatcttcacaaatttttaagttggtgaaaactttttggtgggtagttaaaacttgaaatagaaatttactttaccaaaataaactaatgaaaagtaatcactccactccctataataagatttccaacgttcccactaagc

SEQ ID NO: 586 - DNA, 999 bp, Arabidopsis thaliana
  misc_feature (1)..(1000): Ceres Promoter YP0022
tagttccattacaatttccaaatgatttgttacaaagctacaagattattcgaaataggatttcatccataagagagaatggtgtggtcgacgctacaatgttgatttattggttgtggtttgcatcttggggatgtcaaatcctaagtttcaagttcttgtaaaaacgttttcaggtttctttaatatattttaatattaatgtaaaaagaaaagatatagcttttgtacaaaaaaatttgtttaatcactatgtaggaggatgcgatcaaattcatggaatgatgtattattagcttttctatcctcactctaaaaacaatactatagtgagttaaataatttgatcatttcaatgtagattaaaattttattaaaagaagaaaaatttaaaagcctataacaaaataaaaaaggaggctcgaggtatgatgggtgtagcagaagagctggcaacagctatcgactgagtgattacgaactcagtactcagtgttctcagctcacacactctttttttgttctctttcttttggacagctttcattttctcttttcttttttctattttgtttcaaaattccatccatattaaaataggcctgatcatgagaataaaggaaatactaatgatgagtttctcaataatgcaataagatgcaattattatgagctatttactattgaaaatgagcaaataaatgtcaaaacacaatctggttaagttagagcaactccattgtataggattcatgtagtttctaagaaaacaaaatgtattaatattttacttttacatccaaaaaaccaacttatatgagtaatagaaacgatcctaatattaggaattttagagattttctctcatctgtttcttaacttttcaatatttttattttttaaaattgtatgagtttctactaagaaactactgctggagttggtcttagcttcccaatgcttctccacctatatatatgcatatctccttcttaaaac

SEQ ID NO: 587 - DNA, 999 bp, Arabidopsis thaliana
  misc_feature (1)..(1000): Ceres Promoter YP0080
aagcggcaatttagtaagaagtactcaaagtatcatttaccaaaagtatatggttttgggaagagttgttagggatgtattctttctaaacagatgatatgacgatgttcttgaaaactaatgttaaagacggaatctctggcatcttcactcgggagatatattaaaccgttgattgtagttagccatgtacttagcttagtgcacaaataatctgctgcaagaaatctttttctattataatatctctcatttaaacattagaacatattgtttaacttgttcttctagaaataaaactgctaatttcttatggtaaactattttcctttagattgcacaatcgaactcgaaaatctagtggagactatgtgactatgtttatatatatgaaacctaaatcaaattatcccaataattgggagacacaaaagaaaaattacgaaagaaaacaggaaatcaaatcaaaagataaagagaaggtaaaaaaaggcaagaagcactaatgtttaatatttatagttttctccattaaagaaaaagcgatgatgtgtgttctcatcttttgtgaaagtatatatattgcttttgcttttctcaaaagcaaaagactcatccaacaagaacaaaaaaaaaaactaaagctcaatccaaaagacgaagaatgcattggatactacaacttctttttcacttttctttcaaatttacaattatgattttcacaatacagtttattcaaaaataaataaaaaaacgaggcatgaaaataatgattatcctcttcacttattaagccactcactataagcagagcaactccagaacatagtgagcccccaaaacattaaagcatgatgatgtctaatgatgatgatcttcttcgttccatttctctaaatttttgggatttctgcgaagacccttcttctctttctcttctctgaacttcaagattcgtgtcggacaaatttttgtttttatttttctgatgttaca

SEQ ID NO: 588 - DNA, 1000 bp, Arabidopsis thaliana
  misc_feature (1)..(1000): Ceres Promoter YP0388
agaagtattcacgcaccaaggttatatttgtagtgacatattctacaattatcacatttttctcttatgtttcgtagtcgcagatggtcaattttttctataataatttgtccttgaacacaccaaactttagaaacgatgatatataccgtattgtcacgctcacaatgaaacaaacgcgatgaatcgtcatcaccagctaaaagcctaaaacaccatcttagttttcactcagataaaaagattatttgtttccaacctttctattgaattgattagcagtgatgacgtaattagtgatagtttatagtaaaacaaatggaagtggtaataaatttacacaacaaaatatggtaagaatctataaaataagaggttaagagatctcatgttatattaaatgattgaaagaaaaacaaactattggttgatttccatatgtaatagtaagttgtgatgaaagtgatgacgtaattagttgtatttatagtaaaacaaattaaaatggtaaggtaaatttccacaacaaaacttggtaaaaatcttaaaaaaaaaaaaagaggtttagagatcgcatgcgtgtcatcaaaggttctttttcactttaggtctgagtagtgttagactttgattggtgcacgtaagtgtttcgtatcgcgatttaggagaagtacgttttacacgtggacacaatcaacggtcaagatttcgtcgtccagatagaggagcgatacgtcacgccattcaacaatctcctcttcttcattccttcattttgattttgagttttgatctgcccgttcaaaagtctcggtcatctgcccgtaaatataaagatgattatatttatttatatcttctggtgaaagaagctaatataaagcttccatggctaatcttgtttaagcttctcttcttcttctctctcctgtgtctcgttcactagttttttttcgggggagagtgatggagtgtgtttgttgaatagttttgacgatca

SEQ ID NO: 589 - DNA, 283 bp, Arabidopsis thaliana
  misc_feature (1)..(1000): Ceres Promoter PD0901
caaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagctttttaaaatatttctccacgtgcctctttgtgtttgtctatata

SEQ ID NO: 590 - DNA, 1000 bp, Arabidopsis thaliana
  misc_feature (1)..(1000): Ceres Promoter PT0623
aaagttattgacattttgaaaggaccgtaaatattaccaaaaaactgacggagttaggatcggccacgtagaaagggacaaagagagaacagtcacggactcggccagactaagtatgggcctgtctgaatccaaactcagctaagttccaaaagcataaagagagatgtgtaatgaaatgaacgtattctagaaacgaaagcaatgttatgctttgtttttgagccacatgtttttgggagatggagagaatcttttttacgtttttaacctaacccacttggcacttggccaaaaaagtgagaagaaactgtggcgaatgagtaggccacgccatggactttgttccttgtccttcaaaagttaaatttatgttatgcgtggggacaatctaagcaacgtggttcctttaaatatcgcagcttcctcttttacacttttggagcctacgtgttttgttttggaccggccaaatacacgagtcagtcagtttagaaataatttggatgtccaaaaatcttggagatccaaataaaataattagcatgttttagttcataagaatatgaaatgtagataaactgtctatattaatttttccatagaattggctttttatcgaggtgatgtacttaatgactttgttgattactactcgtataacaataaagaatatgatactatgtgagacttataatgaatttggtgtgtgttaattaatccagttgaaacagtttaataacaaatcagaataaaaattgtagtaagaaaatttgaacgctgatccttcaacctagatagtgaacctttcaaatactatatgattcacgtgtaatgtttttgaccgttggttatttttgtgtgaactatattaacttatcaatatcgaaaggctaaataagtaaataactaaaagaaagttcaggaaacaactcgacctaatgacctatcatttctgatcacccgtcctataaatacatacgtaagatcattcgttact

What is claimed is:

1. A method of modulating the level of oil in a plant, said method comprising introducing into a plant cell an isolated nucleic acid comprising a nucleotide sequence encoding a polypeptide having 80 percent or greater sequence identity to the amino acid sequence set forth in SEQ ID NO: 136, said polypeptide having tryptophan/tyrosine permease activity, wherein a tissue of a plant produced from said plant cell has a difference in the level of oil as compared to the corresponding level in tissue of a control plant that does not comprise said nucleic acid.

2. The method of claim 1, wherein said sequence identity is 85 percent or greater.

3. The method of claim 2, wherein said sequence identity is 90 percent or greater.

4. The method of claim 2, wherein said sequence identity is 95 percent or greater.

5. The method of claim 1, wherein said nucleotide sequence encodes a polypeptide comprising the amino acid sequence set forth in SEQ ID NO:136.

6. The method of claim 1, wherein said difference is an increase in the level of oil.

7. The method of claim 1, wherein said isolated nucleic acid is operably linked to a regulatory region.

8. The method of claim 7, wherein said regulatory region is a tissue-preferential regulatory region.

9. The method of claim 8, wherein said tissue-preferential regulatory region is a promoter.

10. The method of claim 7, wherein said regulatory region is a broadly expressing promoter.

11. The method of claim 1, wherein said plant is a dicot.

12. The method of claim 11, wherein said plant is a member of the genus Anacardium, Arachis, Azadirachta, Brassica, Cannabis, Carthamus, Corylus, Crambe, Cucurbita, Glycine, Gossypium, Helianthus, Jatropha, Juglans, Linum, Olea, Papaver, Persea, Prunus, Ricinus, Sesamum, Simmondsia, or Vitis.

13. The method of claim 1, wherein said plant is a monocot.

14. The method of claim 13, wherein said plant is a member of the genus Cocos, Elaeis, Oryza, or Zea.

15. The method of claim 1, wherein said tissue is seed tissue.

16. A method of producing a plant tissue, said method comprising growing a plant cell comprising an exogenous nucleic acid comprising a nucleotide sequence encoding a polypeptide having 80 percent or greater sequence identity to the amino acid sequence set forth in SEQ ID NO: 136, said polypeptide having tryptophan/tyrosine permease activity, wherein said tissue has a difference in the level of oil as compared to the corresponding level in tissue of a control plant that does not comprise said nucleic acid.

17. The method of claim 16, wherein said sequence identity is 85 percent or greater.

18. The method of claim 17, wherein said sequence identity is 90 percent or greater.

19. The method of claim 17, wherein said sequence identity is 95 percent or greater.

20. The method of claim 16, wherein said nucleotide sequence encodes a polypeptide comprising the amino acid sequence set forth in SEQ ID NO:136.

21. The method of claim 16, wherein said difference is an increase in the level of oil.

22. The method of claim 16, wherein said exogenous nucleic acid is operably linked to a regulatory region.

23. The method of claim 22, wherein said regulatory region is a tissue-preferential regulatory region.

24. The method of claim 23, wherein said tissue-preferential regulatory region is a promoter.

25. The method of claim 22, wherein said regulatory region is a broadly expressing promoter.

26. The method of claim 16, wherein said plant tissue is dicotyledonous.

27. The method of claim 26, wherein said plant tissue is a member of the genus *Anacardium, Arachis, Azadirachta, Brassica, Cannabis, Carthamus, Corylus, Crambe, Cucurbita, Glycine, Gossypium, Helianthus, Jatropha, Juglans, Linum, Olea, Papaver, Persea, Prunus, Ricinus, Sesamum, Simmondsia*, or *Vitis*.

28. The method of claim 16, wherein said plant tissue is monocotyledonous.

29. The method of claim 28, wherein said plant tissue is a member of the genus *Cocos, Elaeis, Oryza*, or *Zea*.

30. The method of claim 16, wherein said tissue is seed tissue.

31. A plant cell comprising an exogenous nucleic acid comprising a nucleotide sequence encoding a polypeptide having 80 percent or greater sequence identity to the amino acid sequence set forth in SEQ ID NO:136, said polypeptide having tryptophan/tyrosine permease activity, wherein a tissue of a plant produced from said plant cell has a difference in the level of oil as compared to the corresponding level in tissue of a control plant that does not comprise said nucleic acid.

32. The plant cell of claim 31, wherein said sequence identity is 85 percent or greater.

33. The plant cell of claim 32, wherein said sequence identity is 90 percent or greater.

34. The plant cell of claim 32, wherein said sequence identity is 95 percent or greater.

35. The plant cell of claim 31, wherein said nucleotide sequence encodes a polypeptide comprising the amino acid sequence set forth in SEQ ID NO:136.

36. The plant cell of claim 31, wherein said difference is an increase in the level of oil.

37. The plant cell of claim 31, wherein said exogenous nucleic acid is operably linked to a regulatory region.

38. The plant cell of claim 37, wherein said regulatory region is a tissue-preferential regulatory region.

39. The plant cell of claim 38, wherein said tissue-preferential regulatory region is a promoter.

40. The plant cell of claim 37, wherein said regulatory region is a broadly expressing promoter.

41. The plant cell of claim 31, wherein said plant is a dicot.

42. The plant cell of claim 41, wherein said plant is a member of the genus *Anacardium, Arachis, Azadirachta, Brassica, Cannabis, Carthamus, Corylus, Crambe, Cucurbita, Glycine, Gossypium, Helianthus, Jatropha, Juglans, Linum, Olea, Papaver, Persea, Prunus, Ricinus, Sesamum, Simmondsia*, or *Vitis*.

43. The plant cell of claim 31, wherein said plant is a monocot.

44. The plant cell of claim 43, wherein said plant is a member of the genus *Cocos, Elaeis, Oryza*, or *Zea*.

45. The plant cell of claim 31, wherein said tissue is seed tissue.

46. A transgenic plant comprising the plant cell of claim 31.

47. Progeny of the plant of claim 46, wherein said progeny has a difference in the level of oil as compared to the level of oil in a corresponding control plant that does not comprise said exogenous nucleic acid.

48. Seed from a transgenic plant according to claim 46.

49. Vegetative tissue from a transgenic plant according to claim 46.

50. A food product comprising seed or vegetative tissue from a transgenic plant according to claim 46.

51. A feed product comprising seed or vegetative tissue from a transgenic plant according to claim 46.

52. A method of making oil, said method comprising extracting oil from the seed of claim 48.

53. A method of modulating the level of oil in a plant, said method comprising:
a) introducing into a plant cell an isolated nucleic acid comprising a nucleotide sequence encoding a polypeptide having 80 percent or greater sequence identity to the amino acid sequence set forth in SEQ ID NO: 136 to generate stably transformed plant cells, said polypeptide having tryptophan/tyrosine permease activity; and
b) selecting at least one plant from a population of plants derived from said transformed plant cells that has a difference in the level of oil in a tissue of said selected plant as compared to the corresponding level of oil in tissue of a control plant that does not comprise said nucleic acid.

54. The method of claim 53, wherein said difference is an increase in the level of oil.

55. The method of claim 53, wherein said polypeptide has the amino acid sequence set forth in SEQ ID NO:136.

\* \* \* \* \*